US012618055B2

(12) United States Patent
Park et al.

(10) Patent No.: US 12,618,055 B2
(45) Date of Patent: May 5, 2026

(54) HYALURONIDASE VARIANTS WITH IMPROVED STABILITY AND PHARMACEUTICAL COMPOSITION COMPRISING THE SAME

(71) Applicant: ALTEOGEN Inc., Daejeon (KR)

(72) Inventors: Soon Jae Park, Daejeon (KR);
Hye-Shin Chung, Daejeon (KR);
Seung Joo Lee, Daejeon (KR);
Kyuwan Kim, Daejeon (KR);
Hyung-Nam Song, Daejeon (KR);
Sun-Ah You, Daejeon (KR); Chang Woo Lee, Daegu (KR)

(73) Assignee: ALTEOGEN Inc., Daejeon (KR)

( * ) Notice: Subject to any disclaimer, the term of this patent is extended or adjusted under 35 U.S.C. 154(b) by 811 days.

(21) Appl. No.: 17/608,729

(22) PCT Filed: Jan. 25, 2021

(86) PCT No.: PCT/KR2021/000943
§ 371 (c)(1),
(2) Date: Nov. 3, 2021

(87) PCT Pub. No.: WO2021/150079
PCT Pub. Date: Jul. 29, 2021

(65) Prior Publication Data
US 2023/0250408 A1 Aug. 10, 2023

(30) Foreign Application Priority Data
Jan. 23, 2020 (KR) ........................ 10-2020-0009046

(51) Int. Cl.
*C12N 9/26* (2006.01)
*A61K 45/06* (2006.01)
*C12N 15/63* (2006.01)

(52) U.S. Cl.
CPC ............ *C12N 9/2474* (2013.01); *A61K 45/06* (2013.01); *C12N 15/63* (2013.01); *C12N 2320/30* (2013.01)

(58) Field of Classification Search
None
See application file for complete search history.

(56) References Cited

U.S. PATENT DOCUMENTS 5,721,348 A 2/1998 Primakoff et al.
5,854,046 A 12/1998 Au-Young et al.
(Continued)

FOREIGN PATENT DOCUMENTS

AR 027553 A1 4/2003
AU 2013202020 A1 4/2013
(Continued)

OTHER PUBLICATIONS

Appendix A sequence alignment, 2024 (Year: 2024).*
(Continued)

*Primary Examiner* — Thane Underdahl
*Assistant Examiner* — Mary A Crum
(74) *Attorney, Agent, or Firm* — Sughrue Mion, PLLC

(57) ABSTRACT

Disclosed are novel PH20 variants or fragments thereof with improved thermal stability and enzymatic activity of human hyaluronidase, which is an enzyme that hydrolyzes hyaluronic acid, and more particularly novel PH20 variants or fragments thereof including one or more amino acid residue substitutions in the variant having the amino acid sequence of SEQ ID NO: 3, wherein one or more amino acid residues at the N-terminus and/or the C-terminus are optionally further deleted.

32 Claims, 6 Drawing Sheets
Specification includes a Sequence Listing.

(56) References Cited

U.S. PATENT DOCUMENTS

| | | |
|---|---|---|
| 7,767,429 B2 | 8/2010 | Bookbinder et al. |
| 8,105,586 B2 | 1/2012 | Bookbinder et al. |
| 8,202,517 B2 | 6/2012 | Bookbinder et al. |
| 8,257,699 B2 | 9/2012 | Bookbinder et al. |
| 8,288,142 B2 | 10/2012 | Uvarkina et al. |
| 8,431,124 B2 | 4/2013 | Bookbinder et al. |
| 8,431,380 B2 | 4/2013 | Bookbinder et al. |
| 8,450,470 B2 | 5/2013 | Bookbinder et al. |
| 8,580,252 B2 | 11/2013 | Bookbinder et al. |
| 8,765,685 B2 | 7/2014 | Bookbinder et al. |
| 8,772,246 B2 | 7/2014 | Bookbinder et al. |
| 8,927,249 B2 | 1/2015 | Wei et al. |
| 9,211,315 B2 | 12/2015 | Bookbinder et al. |
| 9,284,543 B2 | 3/2016 | Wei et al. |
| 9,447,401 B2 | 9/2016 | Wei et al. |
| 9,562,223 B2 | 2/2017 | Bookbinder et al. |
| 9,677,061 B2 | 6/2017 | Bookbinder et al. |
| 9,677,062 B2 | 6/2017 | Bookbinder et al. |
| 10,286,044 B2 | 5/2019 | Bookbinder et al. |
| 10,328,130 B2 | 6/2019 | Frost et al. |
| 10,865,400 B2 | 12/2020 | Wei et al. |
| 10,898,551 B2 | 1/2021 | Bookbinder et al. |
| 10,918,736 B2 | 2/2021 | Kim et al. |
| 11,041,149 B2 | 6/2021 | Wei et al. |
| 11,066,656 B2 | 7/2021 | Wei et al. |
| 11,723,959 B2 | 8/2023 | Bookbinder et al. |
| 12,091,692 B2 | 9/2024 | Wei et al. |
| 12,104,185 B2 | 10/2024 | Wei et al. |
| 2006/0104968 A1 | 5/2006 | Bookbinder et al. |
| 2009/0123367 A1 | 5/2009 | Bookbinder et al. |
| 2010/0003238 A1 | 1/2010 | Frost et al. |
| 2010/0143457 A1 | 6/2010 | Wei et al. |
| 2010/0305500 A1 | 12/2010 | Lambert et al. |
| 2011/0044977 A1 | 2/2011 | Adler |
| 2012/0148535 A1 | 6/2012 | Carrio et al. |
| 2013/0101577 A9 | 4/2013 | Wei et al. |
| 2013/0302275 A1 | 11/2013 | Wei et al. |
| 2014/0037613 A1 | 2/2014 | Bookbinder et al. |
| 2014/0199282 A1 | 7/2014 | Bookbinder et al. |
| 2015/0001529 A1 | 1/2015 | Kurokawa |
| 2015/0010529 A1 | 1/2015 | Wei |
| 2015/0165059 A1 | 6/2015 | Bookbinder et al. |
| 2016/0362670 A1 | 12/2016 | Wei et al. |
| 2017/0089914 A1 | 3/2017 | Loo et al. |
| 2017/0218069 A1 | 8/2017 | Rosengren et al. |
| 2017/0218382 A1 | 8/2017 | Kondo |
| 2018/0044419 A9 | 2/2018 | Rosengren et al. |
| 2018/0185506 A1 | 7/2018 | Bookbinder et al. |
| 2018/0250397 A1 | 9/2018 | Benyunes et al. |
| 2019/0046657 A1 | 2/2019 | Kim et al. |
| 2020/0262922 A1 | 8/2020 | Bhattacharya et al. |
| 2021/0155913 A1* | 5/2021 | Park .................... C12N 9/2402 |
| 2021/0205311 A1 | 7/2021 | Wang et al. |
| 2021/0346497 A1 | 11/2021 | Huber |
| 2021/0363270 A1* | 11/2021 | Park .................... A61K 9/0019 |
| 2022/0089738 A1 | 3/2022 | Krishnamachari et al. |
| 2022/0289864 A1 | 9/2022 | Park et al. |
| 2023/0174963 A1 | 6/2023 | Park et al. |
| 2023/0250408 A1 | 8/2023 | Park et al. |
| 2023/0321203 A1 | 10/2023 | Bookbinder et al. |
| 2023/0365692 A1 | 11/2023 | Krishnamachari et al. |
| 2024/0150467 A1 | 5/2024 | Akala et al. |

FOREIGN PATENT DOCUMENTS

| | | | |
|---|---|---|---|
| CN | 101970650 A | 2/2011 | |
| CN | 102065886 A | 5/2011 | |
| CN | 102307993 A | 1/2012 | |
| CN | 103173474 A | 6/2013 | |
| CN | 104244968 A | 12/2014 | |
| CN | 104745553 A | 7/2015 | |
| CN | 105567606 A | 5/2016 | |
| CN | 110494450 A | 11/2019 | |
| CN | 111971387 A | 11/2020 | |
| CO | 2021011944 A2 | 9/2021 | |
| EA | 22752 B1 | 2/2016 | |
| EP | 2 405 015 A2 | 1/2012 | |
| EP | 2662090 A1 | 11/2013 | |
| EP | 2 674 487 A1 | 12/2013 | |
| EP | 1858926 B1 | 10/2015 | |
| EP | 3037529 A1 | 6/2016 | |
| EP | 3 045 472 A1 | 7/2016 | |
| EP | 2797622 B1 | 10/2016 | |
| EP | 3 186 281 B1 | 4/2019 | |
| EP | 3130347 B1 | 9/2019 | |
| EP | 3636752 A1 | 4/2020 | |
| EP | 3785701 A1 | 3/2021 | |
| ES | 2573462 T3 | 6/2016 | |
| JP | 2009515521 A | 4/2009 | |
| JP | 2011512844 A | 4/2011 | |
| JP | 2012511327 A | 5/2012 | |
| JP | 2015504666 A | 2/2015 | |
| JP | 2015095423 A | 5/2015 | |
| JP | 2018052818 A | 4/2018 | |
| JP | 2020500863 A | 1/2020 | |
| JP | 2021123202 A | 8/2021 | |
| JP | 2022066832 A | 5/2022 | |
| JP | 2022094567 A | 6/2022 | |
| JP | 7166478 B2 | 7/2022 | |
| JP | 202425986 A | 2/2024 | |
| JP | 202425989 A | 2/2024 | |
| JP | 2024081274 A | 6/2024 | |
| JP | 2024081276 A | 6/2024 | |
| KR | 1020100135291 A | 12/2010 | |
| KR | 20120094493 A | 8/2012 | |
| KR | 1020120105426 A | 9/2012 | |
| KR | 101233457 B1 | 2/2013 | |
| KR | 1020130116386 A | 10/2013 | |
| KR | 101363658 B1 | 2/2014 | |
| KR | 1020140021046 A | 2/2014 | |
| KR | 101493644 B1 | 2/2015 | |
| KR | 101546563 B1 | 8/2015 | |
| KR | 1020160052812 A | 5/2016 | |
| KR | 101647932 B1 | 8/2016 | |
| KR | 10-2017-0065032 A | 6/2017 | |
| KR | 101874401 B1 | 7/2018 | |
| KR | 1020200017538 A | 2/2020 | |
| KR | 10-2020-0130451 A | 11/2020 | |
| KR | 10-2021-0023798 A | 3/2021 | |
| KR | 10-2022-0069045 A | 5/2022 | |
| TW | 201534726 A | 9/2015 | |
| TW | 202140780 A | 11/2021 | |
| WO | 2004078140 A2 | 9/2004 | |
| WO | 2007064437 A2 | 6/2007 | |
| WO | 2009065507 A2 | 5/2009 | |
| WO | 2009111066 A1 | 9/2009 | |
| WO | 2009117085 A1 | 9/2009 | |
| WO | 2009128917 A2 | 10/2009 | |
| WO | 2010077297 A1 | 7/2010 | |
| WO | 2011012637 A2 | 2/2011 | |
| WO | 2011029892 A2 | 3/2011 | |
| WO | 2011034604 A2 | 3/2011 | |
| WO | 2012135408 A | 4/2012 | |
| WO | 2012174478 A2 | 12/2012 | |
| WO | WO2013102144 A2 | 7/2013 | |
| WO | 2015003167 A1 | 1/2015 | |
| WO | 2015071366 A1 | 5/2015 | |
| WO | 2015/095418 A1 | 6/2015 | |
| WO | 2016033555 A1 | 3/2016 | |
| WO | 2016061286 A2 | 4/2016 | |
| WO | 2017004706 A1 | 1/2017 | |
| WO | 2017079150 A1 | 5/2017 | |
| WO | 2017131496 A1 | 8/2017 | |
| WO | 2018102372 A1 | 6/2018 | |
| WO | 2018204368 | 8/2018 | |
| WO | 2018183928 A1 | 10/2018 | |
| WO | 2018222722 A2 | 12/2018 | |
| WO | 2019222435 A1 | 11/2019 | |
| WO | 2020022791 A1 | 1/2020 | |
| WO | 2020197230 A1 | 1/2020 | |
| WO | 2020172621 A1 | 8/2020 | |

(56) References Cited

FOREIGN PATENT DOCUMENTS

| WO | 2021150079 A1 | 7/2021 |
| WO | 2022031093 A1 | 2/2022 |
| WO | 2023075506 A1 | 5/2023 |

OTHER PUBLICATIONS

EESR Issued in counterpart European Patent Application No. 21743774.8 on Jan. 4, 2023.

Pakula, A., et al., "Genetic Analysis of Protein Stability and Function", Annu. Rev. Genet., 1898, pp. 289-310, vol. 23.

Stern, R., et al., "The Hyaluronidases: Their Genomics, Structures, and Mechanisms of Action", Chem Rev, 2006, pp. 818-839, vol. 106, No. 3, Publisher: NIH Public Access.

Witkowski, A., et al., "Conversion of a -Ketoacyl Synthase to a Malonyl Decarboxylase by Replacement of the Active-Site Cysteine with Glutamine", Biochemistry, 1999, pp. 11643-11650, vol. 38, Publisher: American Chemical Society.

CN201980023392.4—Decision of Final Rejection mailed on May 17, 2024, 10 pages.

CA3,093,885—Office Action mailed on Jun. 3, 2024, 4 pages.

JP2022-211105—Decision of Rejection mailed on May 14, 2024, 3 pages.

H. Johansen, et al., "High-level production of fully active human alpha 1-antitrypsin in *Escherichia coli*." Mol. Biol. Med. (1987) vol. 4, pp. 291-305.

J.H. Dunham, et al., "GPR37 Surface Expression Enhancement via N-Terminal Truncation or Protein-Protein Interactions", Biochemistry (2009) 48, pp. 10286-10297.

M. Wei, et al., "N-terminal truncations on L1 proteins of human papillomaviruses promote their soluble expression in *Escherichia coli* and self-assembly in vitro", Emerging Microbes & Infections (2018) vol. 7, p. 160.

M. F. Meyer, et al., "The soluble hyaluronidase from bull testes is a fragment of the membrane-bound PH-20 enzyme", FEBS letter (1997) vol. 413, pp. 385-388.

International Search Report and Written Opinion dated Sep. 21, 2023 in International Application No. PCT/KR2023/008621, pp. 15.

AU2021320569—Examination Report No. 1 mailed on Apr. 30, 2024, 3 pages.

CA3, 131,052—Office Action mailed on May 6, 2024, 5 pages.

CN2021800300979—First Office Action mailed on Jan. 6, 2024, 18 pages.

MX/a/2020/009824—Office Action mailed on Jun. 10, 2024, 16 pages.

TW111145281—First Office Action mailed on May 29, 2024, 16 pages.

TW111128188—First Office Action mailed on May 29, 2024, 24 pages.

TW110102662—Office Action mailed on May 3, 2024, 22 pages.

TW111136059—Office Action mailed on May 3, 2024, 20 pages.

JP2022211105—Notice of Reasons for Refusal mailed on Nov. 14, 2023, 17 pages.

CN201980023392.4—First Office Action mailed on Jun. 17, 2023, 9 pages.

KR20207002955—Written Decision on Registration mailed on Aug. 25, 2020, 16 pages.

JP2020500863—Notice of Reasons for Refusal mailed on Jan. 25, 2022, 7 pages.

JP2020500863—Notice of Reasons for Refusal mailed on May 24, 2022, 6 pages.

JP2020500863—Notice of Reasons for Refusal mailed on Jun. 15, 2021, 12 pages.

EP19827585—Supplementary European search report mailed on Mar. 31, 2021, 9 pages.

JP2022211105—Decision of Rejection mailed on May 14, 2024, 2 pages.

CA3,093,885—Examiner Requisition mailed on Sep. 1, 2021, 4 pages.

CA3,093,885—Examiner Requisition mailed on Oct. 3, 2022, 6 pages.

AU2019311658—Examination Report No. 1 mailed on Jun. 17, 2022, 3 pages.

AU2019311658—Notice of Acceptance mailed on Oct. 11, 2022, 3 pages.

Bazhenova et al., Cancer Research, vol. 77, No. 13, suppl. Abstract No. CT032.

U.S. Appl. No. 17/052,952—Non-Final Office Action mailed on Jun. 13, 2024, 20 pages.

KR20227013211—Request for the Submission of an Opinion mailed on Apr. 26, 2024, 7 pages.

CN202180003323.4—First Office Action mailed on Nov. 27, 2023, 14 pages.

EP21743774—Supplementary European search report mailed on Jan. 4, 2023, 20 pages.

JP2021567961—Decision of Rejection mailed on Nov. 14, 2023, 8 pages.

JP2021567961—Notice of Reasons for Refusal mailed on Apr. 11, 2023, 6 pages.

AU2021211348—Examination Report No. 1 mailed on Mar. 17, 2023, 3 pages.

AU2021211348—Examination Report No. 2 mailed on Jul. 11, 2023, 5 pages.

AU2021211348—Notice of Acceptance mailed on Sep. 21, 2023, 4 pages.

CA3,137,324—Examiner Requisition mailed on Dec. 2, 2022, 4 pages.

CA3,137,324—Examiner Requisition mailed on May 6, 2024, 6 pages.

KR20207030248—Written Decision on Registration mailed on Dec. 22, 2023, 5 pages.

KR20207030248—Notice of Final Rejection mailed on Jul. 27, 2023, 6 pages.

KR20207030248—Request for the Submission of an Opinion mailed on Aug. 28, 2022, 14 pages.

KR20227016935—Written Decision on Registration mailed on Dec. 21, 2022, 6 pages.

JP2022068166—Notice of Reasons for Refusal mailed on Jun. 21, 2022, 8 pages.

JP2022068166—Decision to Grant a Patent mailed on Oct. 4, 2022, 5 pages.

JP2020569741—Notice of Reasons for Refusal mailed on Nov. 16, 2021, 8 pages.

JP2020569741—Decision to Grant a Patent mailed on May 16, 2023, 5 pages.

CN202310416462.0—Notification of grant of patent right for invention mailed on May 16, 2024, 3 pages.

AU2020248612—Examination Report No. 3 mailed on Nov. 8, 2023, 2 pages.

International Search Report dated Feb. 2, 2023 in International Application No. PCT/KR2022/016709, pp. 14.

Strickley et al.,"A review of formulations of commercially available antibodies", Journal of Pharmaceutical Sciences, 2021, vol. 110, pp. 2590-2608.

Zarrintaj et al.,"Poloxamer: A versatile tri-block copolymer for biomedical applications", Acta Biomaterialia, 2020, vol. 110, pp. 37-67.

KR1020210103530—Written Decision on Registration mailed on Dec. 15, 2023, 6 pages.

JP2022559471—Final Notification of Reasons forRefusal mailed on Mar. 19, 2024, 8 pages.

CN202180030097.9—First Office Action mailed on Jan. 6, 2024, 19 pages.

CA3173310—Office action mailed on Dec. 20, 2023, 5 pages.

Wasserman, R.L., "Overview of recombinant human hyaluronidase-faciliated subcutaneous infusion of IgG in primary immunodeficiencies", Immunotherapy, 2014, vol. 6, No. 5, Publisher: Future Medicine, p. 553-567.

Schilling, S., et al., "Heterologous Expression and Characterization of Human Glutaminy Cyclase: Evidence for a Disulfide Bond with Importance for Catalytic Activity", Biochemistry, 2002, vol. 41, Publisher: American Chemical Society, p. 10849-10857.

(56) References Cited

OTHER PUBLICATIONS

Restelli, V., et al., "The Effect of Dissolved Oxygen on the Production and the Glycosylation Profile of Recombinant Human Erythropoietin Produced From CHO Cells", Biotechnol Bioeng, 2006, pp. 481-494, vol. 94.

"Muchmore, D.B., et al., ""Accelerating and Improving the Consistency of Rapid-Acting Analog Insulin Absorption and Action for Both Subcutaneous Injection and Continuous Subcutaneous Infusion Using Recombinant Human Hyaluronidase"", Journal of Diabetes Sciene and Technology, 2012, pp. 764-772, vol. 6, No. 4, Publisher: Diabetes Technology Society".

Locke, K.W., et al., "ENHANZE drug delivery technology: a novel approach to subcutaneous administration using recombinant human hyaluronidase PH20", Drug Delivery, 2019, pp. 98-106; DOI: 10.1080/10717544.2018.1551442, vol. 26, No. 1, Publisher: Taylor & Francis.

Chica et al., "Semi-rational approaches to engineering enzyme activity: Combining the benefits of directed evolution and rational design" Current Opinion in Biotechnology, Aug. 2, 2005005, vol. 16, issue 4, pp. 378-384.

Office Action Issued in Japanese Patent Application No. 2022559471 on Oct. 11, 2023, 15 pages.

CN201980023392.4—Second Office Action mailed on Feb. 8, 2024, 8 pages.

CN202310416462.0—First Office Action mailed on Mar. 5, 2024, 8 pages.

CN202080003052.8—Second Office Action mailed on Mar. 2, 2024, 11 pages.

CN202080003052.8—First Office Action mailed on Jun. 27, 2023, 12 pages.

JP2023026863—Notice of Reasons for Refusal mailed on Mar. 12, 2024, 10 pages.

Thomas, J., et al., "The INFUSE-Morphine IIB Study: Use of Recombinant Human Hyaluronidase (rHuPH20) to Enhance the Absorption of Subcutaneous Morphone in Healthy Volunteers", "Journal of pain and symptom Management", Nov. 2009, pp. 673-682, vol. 38, No. 5.

Kreidieh, F., et al., "Overview, Prevention and Management of Chemotherapy Extravasation", "World Journal of Clinical Oncology", Feb. 10, 2016, pp. 87-97, vol. 7, No. 1.

Hofinger, E., et al., "Kinetics of Hyal-1 and PH-20 Hyaluronidases: Comparison of Minimal Substrates and Analysis of the Transglycosylation Reaction", "Glycobiology", 2007, pp. 963-971, vol. 17, No. 9.

Chen, K., et al., "Constitutive Expression of Recombinant Human Hyaluronidase PH20 by Pichia Pastoris", "Journal of Bioscience and Bioengineering", 2016, pp. 1-6.

Borders, C., et al., "Purification and Partial Characterization of Testicular Hyaluronidase", The Journal of Biological Chemistry, 1968, vol. 243, No. 13, p. 3756-3762.

Shpilberg, O., et al., "Subcutaneous administration of rituximab (MabThera) and trastuzumab (Herceptin) using D hyaluronidase", Britich Journal of Cancer, 2013, vol. 109, p. 1556-1561.

Bittner, B., et al., "Subcutaneous Administration of Biotherapeutics—An Overview of Current Challenges and D Opportunities", BioDrugs, 2018, vol. 32, Publisher: CrossMark, p. 425-440.

Opposition by Laboratorios Legrand S.A. Against Columbian Patent Application NC20210012380 with English Translation Oct. 20, 2021, pp. 21.

Office Action issued in Saudia Arabia Patent Application No. 521430398 with English Translation on Feb. 25, 2023, pp. 11.

Office Action issued in Georgian Patent Application No. AP202015767 with English Translation on Apr. 3, 2023, pp. 9.

Opposition filed against Ecuador Patent Application SENADI-2021-70640 with English Translation on Feb. 14, 2022, pp. 217.

Office Action issued in Korean Patent Application No. 20227016935 on Aug. 28, 2022, pp. 20.

Office Action issued in Japanese Patent Application No. 2020569741 on Aug. 23, 2022, pp. 5.

Office Action issued in Chile Patent Application No. 202102464 with English Translation on May 4, 2023, pp. 23.

Opposition filed Jan. 13, 2022 by Laboratorios Legrand S.A. against Columbian Patent Application No. NC2021/0012380, pp. 21.

Opposition dated Jul. 5, 2022 by Asociacion de Laboratorios Farmaceuticos (ALAFAR) Against Ecuadorian Application No. SENADI-2021-70640, pp. 3.

Office Action issued on Sep. 5, 2022 in counterpart Taiwan Patent Application 110130965, pp. 6.

Singh et al., "Protein Engineering Approaches in the Post-Genomic Era", Current Protein and Peptide Science, 2017, vol. 18, pp. 1-11.

NCBI Reference Sequence, hyaluronidase PH-20 precursor [Cavia porcelius], NP_001166492.1, Jun. 21, 2021 pp. 2 (downloaded Aug. 24, 2023).

Tachibana, H., et al., "Changes of monosacharide availability of human hybridoma lead to alteration of biological properties of human monoclonal antibody", Cytotechnology, 1994, vol. 16, Publisher: Kiuwer Academic Publishers, pp. 151-157.

Krantz, E.M., "Low-Dose Intramuscular Ketamine and Hyaluronidase for Induction of Anaesthesia in NonPemedicated Children", S.A. Med. J., 1980, vol. 58, No. 4, pp. 161-162.

Harris, R.J., et al., "Commercial Manufacturing Scale Formulation and Analytical Characterization of Therapeutic Recombinant Antibodies", Drug Development Research, 2004, vol. 61, pp. 137-154.

Harb, G., et al., "Safety and pharmakokinetics of subcutaneous ceftriaxone administered with or without recombinant human hyaluronidase (rHuPH20) versus intravenous ceftriaxone administration in adult volunteers", Current Medical Research & Opinion, 2010, vol. 26, No. 2, Publisher: CMRO, pp. 279-288.

Borys, M.C., et al., "Culture pH Affects Expression Rates and Glycosylation of Recombinant Mouse Placental Lactogen Proteins by Chinese Hamster Ovary (CHO) Cells", Biotechnology, 1993, vol. 11, Publisher: Nature Publishing Group, pp. 720-724.

Borys, M.C., et al., "Ammonia Affects the Glycosylation Patterns of Recombinant Mouse Placental Lactogen-I by Chinese Hamster Overy Cells in a pH-Dependent Manner", Biotechnology and Bioengineering, 1994, vol. 43, Publisher: John Wiley & Sons, Inc., pp. 505-514.

Clark, K.J.R., et al., "Temperature Effects on Product-Quality-Related Enzymes in Batch CHO Cell Cultures Producing Recombinant tPA", Biotechnol. Prog., 2004, vol. 20, Publisher: American Chemical Society, pp. 1888-1892.

Clement, WA, et al., "The use of hyaluronidase in nasal infiltration: prospective randomized controlled pilot study", The Journal of Laryngology & Otology, 2003, vol. 117, pp. 614-618.

Arming, S., et al., "In vitro mutagenesis of PH-20 hyaluronidase from human sperm", Eur. J. Biochem, 1997, pp. 810-814, vol. 247.

Bookbinder, L.H., et al., "A recombinant human enzyme for enhanced interstitial transport of therapeutics", Journal of Controlled Release, 2006, pp. 230-241, vol. 114, Publisher: Science Direct.

Chao, K., et al., "Structure of Human Hyaluronidase-1, a Hyaluronan Hydrolyzing Enzyme Involved in Tumor Growth and Angiogenesis", Biochemistry, 2007, pp. 6911-6920, vol. 46, Publisher: American Chemical Society.

Chen, K-J, et al., "Constitutive expression of recombinant human hyaluronidase PH20 by Pichia pastoris", Journal of Bioscience and Bioengineering, 2016, pp. 673-678, vol. 122, Publisher: Elsevier.

Frost, G.I., "Recombinant human hyaluronidase (rHuPH20): an enabling platform for subcutaneous drug and fluid administration", Expert Opin Drug Deliv, 2007, pp. 427-440, vol. 4.

"GenBank: AAC6067.2 PH-20 (Homo sapiens)", NCBI, 2000.

Schon, A., et al., "Denatured state aggregation parameters derived from concentration dependence of protein stability", Analytical Biochemistry, 2015, pp. 45-50, vol. 488, Publisher: Elsevier.

Chan et al., "Therapeutic antibodies for autoimmunity and inflammation", Nature Reviews Immunology, vol. 10, May 2010, pp. 301-316.

Alley et al., "Long-Term Overall Survival for Patients with Malignant Pleural Mesothelioma on Pembrolizumab Enrolled in KEYNOTE-028", Journal of Thoracic Oncology, Abstract No. OA13.03, 2018, vol. 12, No. 1S, p. 1 (S294).

Liming Liu, "Pharmacokinetics of monoclonal antibodies and Fc-fusion proteins", Protein Cell, 2018, vol. 9, No. 1, pp. 15-32.

(56) References Cited

OTHER PUBLICATIONS

U.S. Appl. No. 17/052,952—Non-Final Office Action mailed on Dec. 12, 2023, 32 pages.
International Search Report and Written Opinion mailed Jul. 29, 2021 for International Patent Application No. PCT/KR2021/000943 filed Mar. 24, 2020 (21 pages).
International Search Report and Written Opinion mailed Jun. 30, 2020 for International Patent Application No. PCT/KR2020/003975 filed Mar. 24, 2020 (23 pages).
International Search Report and Written Opinion mailed Oct. 29, 2019 for PCT Application No. PCT/KR2019/009215 filed Jul. 25, 2019 (21 pages).
Lin et al. "Molecular cloning of the human and monkey sperm surface protein PH-20", Proc. Natl. Acad. Sci. Nov. 1993, vol. 90, pp. 10071-10075.
McAtee, C., et al., "Emerging roles for hyaluronidase in cancer metastasis and therapy", "Advances in cancer research", 2014, vol. 123, pp. 1-34.
Muller et al., "Spliceosomal peptide P140 for immunotherapy of systemic lupus erythematosus", Arthritis & Rheumatism, Dec. 2008, vol. 58, Nb. 12, pp. 3873-3883.
Hyaluronidase PH-20 (Macaca nemestrina) NCBI Reference Sequence: XP011728213.1, Apr. 24, 2018, p. 2.
NCBI Reference Sequence: NP 001166492.1 , hyaluronidase PH-20 precursor [Cavia porcelius], Jun. 21, 2021, pp. 2.
NCBI Reference Sequence: NP 001166492.1 , hyaluronidase PH-20 precursor [Cavia porcelius], Jun. 19, 2020, pp. 2.
"PH-20 (*Homo sapiens*)", NCBI Genbank Accession No. AAC60607.2, Jun. 5, 2000, p. 1.
Wang et al., "Antibody structure, instability, and formulation,"Journal of pharmaceutical sciences., Jan. 2007, vol. 96, Nb.1, pp. 1-26.
Frost and Stern, "A microtiter-based assay for hyaluronidase activity not requiring specialized reagents", "Analytical Biochemistry", 1997, vol. 251, pp. 263-269.
Markovic-Housley et al., "Crystal structure of hyaluronidase, a major allergen of bee venom", "Structure", Oct. 2000, vol. 8, , pp. 1025-1035.
Messina et al., "Identification and characterization of a bacterial hyaluronidase and its production in recombinant form", "FEBS Letters", 2016, vol. 590, Issue 14, pp. 2180-2189.
Stern and Csoka, "Mammalian Hyaluronidases", "Glycoforum", 2000, vol. 4, pp. 1-6.
Lafaro et al., "The Paradoxical Web of Pancreatic Cancer Tumor Microenvironment", The American journal of pathology, vol. 189, No. 1, pp. 44-57.
Philo et al., "A Critical Review of Methods for Size Characterization of Non-Particulate Protein Aggregates," J.S. Cur. Pharm. Biotech., 2009, vol. 10, 359-372.
Takahashi, T. et al., "A fluorimetric Morgan-Elson assay method for hyaluronidase activity," Anal. Biochem., 2003, vol. 322, 257-263.
Office Action issued in Australian Patent Application No. 2020248612 on Nov. 8, 2022, pp. 3.
Office Action issued in Canadian Patent Application No. 3131052 on Oct. 19, 2022, pp. 6.
U.S. Appl. No. 17/907,538—Requirement for Restriction/Election mailed on May 12, 2023, 5 pages.
U.S. Appl. No. 17/907,538—Non-Final Office Action mailed on Aug. 3, 2023, 10 pages.
U.S. Appl. No. 17/907,538—Ex Parte Quayle Action mailed on Feb. 15, 2024, 4 pages.
U.S. Appl. No. 17/907,538—Notice of Allowance mailed on Apr. 24, 2024, 7 pages.
U.S. Appl. No. 16/628,258—Final Rejection mailed on Mar. 12, 2024, 9 pages.
U.S. Appl. No. 16/628,258—Non-Final Office Action mailed on Aug. 30, 2023, 13 pages.
U.S. Appl. No. 16/628,258—Requirement for Restriction/Election mailed on Mar. 23, 2023, 9 pages.
CA3137324—Office Action mailed on May 6, 2024, 6 pages.

AU2020248612—Notice of Acceptance mailed on Sep. 21, 2023, 4 pages.
RU2021132331—Office Action mailed on Nov. 3, 2023, 16 pages.
International Search Report and Written Opinion dated Nov. 18, 2021 in International Application No. PCT/KR2021/010368, pp. 17.
RU2022125351—Office Action mailed on Nov. 2, 2023, 15 pages.
KR20210103530—Request for the Submission of an Opinion mailed on Sep. 19, 2023, 7 pages.
EP20776465.5—Extended European search report mailed on Feb. 11, 2022, 15 pages.
AU2020248612—Examination Report No. 2 mailed on Oct. 25, 2023, 3 pages.
JP2021567961—Office Action mailed on Jul. 2, 2024, 6 pages.
CN202180003323.4—Office Action mailed on Jul. 10, 2024, 12 pages.
Tavares, A. et al., "Inhibition of the checkpoint protein PD-1 by the therapeutic antibody pembrolizumab outlined by quantum chemistry", Scientific Reports, vol. 8, Issue 1840, pp. 1-13.
CONC20210012380—Office Action mailed on Jan. 11, 2024, 16 pages.
EA202192588—Office Action mailed on Sep. 29, 2023, 8 pages.
IDP00202108509—Office Action mailed on Sep. 27, 2023, 4 pages.
PA93644-01—Search Report mailed on Mar. 29, 2022, 8 pages.
VN1-2021-06635—Office Action mailed on Feb. 26, 2024, 3 pages.
U.S. Appl. No. 16/628,258—Notice of Allowance mailed on Jul. 16, 2024, 8 pages.
Office Action dated Jul. 9, 2021 in Taiwanese Patent Application No. 109119328.
Broun, P., et al., "Catalytic Plasticity of Fatty Acid Modification Enzymes Underlying Chemical Diversity of Plant Lipids", Science, 1998, pp. 1315-1317, vol. 282, No. 13, Publisher: www.sciencemag.org.
Hiromoto, Y., et al., "An Activity-Straining Method on Filtration Paper Enables High-Throughput Screening of Temperature-Sensitive and Inactive Mutations of Rice -Amylase for Improvement of Rice Grain Quality", Plant and Cell Physiology, 2017, pp. 658-667, vol. 58, No. 4, Publisher: Japanese Society of Plant Physiologists.
Office Action issued on Dec. 2, 2022 in counterpart Canadian Patent Application No. 2137324, Dec. 2, 2022.
Office Action issued on Oct. 17, 2022 in counterpart Russian Patent Application No. 2021132331, Oct. 17, 2022.
English Translation of Office Action issued on Oct. 17, 2022 in counterpart Russian Patent Application No. 2021132331, Oct. 17, 2022.
Seffernick, J.L., et al., "Melamine Deaminase and Atrazine Chlorohydrolase: 98 Percent Identical but Functionally Different", Journal of Bacteriology, 201, pp. 2405-2410, vol. 183, No. 8, Publisher: American Society for Microbiology.
Whisstock, J.D., et al., "Prediction of protein function from protein sequence and structure", Quarterly Reviews of Biophysics, 2003, pp. 307-340, vol. 36, No. 3, Publisher: Cambridge University Press.
Hardy et al., "Assessment of contraceptive vaccines based on recombinant mouse sperm protein PH20," Reprod., 127:325-334 (2004).
Hayden, "Chemistry: Designer Debacle," Nature, 453:275-278 (2008).
Hayden, "Key Protein-Design Papers Challenged," Nature, 461:859 (2009).
Green, "Computer Graphics, Homology Modeling, and Bioinformatics," Protein Eng'g & Design, Ch. 10, 223-237 (2010).
EP20776465.5—Communication pursuant to 94(3) EPC mailed on Jul. 16, 2024, 7 pages.
File History of U.S. Pat. No. 11,952,600.
TW111136059—Second Office Action mailed on Sep. 5, 2024, 6 pages.
Yue et al., "Loss of Protein Structure Stability as a Major Causative Factor in Monogenic Disease," J. Mol. Biol., 353:459-473 (2005).
Zhang et al., "Hyaluronidase Activity of Human Hyal1 Requires Active Site Acidic and Tyrosine Residues," J. Biol. Chem., 284(14):9433-9442 (2009).

(56) References Cited

OTHER PUBLICATIONS

Collection of SWISS-MODEL Webpages from the Internet Archive, navigable from: https://web.archive.org/web/20110519141121/http://swissmodel.expasy.org/?pid=smh01&uid=&token=, accessed Nov. 9, 2024.

Communication dated Dec. 5, 2024 issued by the European Patent Office in application No. 24185844.8.

"Highlights of prescribing information", Keytruda, pp. 1-16, 2014, www.fda.gov/drugsatfda.

Hecht et al., "De Novo Proteins from Designed Combinatorial Libraries," Protein Sci., 13:1711-1723 (2004).

Hom_pre2011 (Exhibit 1053 in PGR2025-00003).

Wang & Moult, "SNPs, Protein Structure, and Disease," Hum. Mutation, 17:263-270 (2001).

Xiong et al., "Periodicity of Polar and Nonpolar Amino Acids is the Major Determinant of Secondary Structure in Self-Assembling Oligomeric Peptides," PNAS, 92: 6349-6353 (1995).

"Negative Results," Nature: Editorials, 453:258 (2008).

Hom_pre2011.fasta (Exhibit 1056 in PGR2025-00003).

Hom_pre2011_header (Exhibit 1054 in PGR2025-00003).

TW110102662—Second Office Action mailed on Sep. 5, 2024, 6 pages.

U.S. Appl. No. 13/694,731.

U.S. Appl. No. 61/631,313.

U.S. Appl. No. 16/628,258—Notice of Allowance mailed on Aug. 16, 2024, 8 pages.

Alberts, "Molecular Biology of the Cell," Fifth Edition, Chapter 3 (2007).

Swiss Model Printout of PH20 Model with D320S Mutation, printed Nov. 9, 2024 (Exhibit 1073 in PGR2025-00003).

Table Associating Citations from the U.S. Pat. No. 11,952,600 Patent (Exhibit 1001 in PGR2025-00003) to Corresponding Citations in U.S. Appl. No. 13/694,731Application (Exhibit 1026 in PGR2025-00003).

Tung et al., "Mechanism of Infertility in Male Guinea Pigs Immunized with Sperm PH-20," Biol. Reprod., 56(5):1133-41 (1997).

Alexander et al., "A Minimal Sequence Code for Switching Protein Structure and Function," PNAS, 106:21149-21154 (2009).

Hom_pre2011_header_clean (Exhibit 1055 in PGR2025-00003).

Hossler et al., "Optimal and consistent protein glycosylation in mammalian cell culture", Glycobiology, vol. 19, No. 9, Jun. 3, 2009, pp. 936-949.

Stern et al., "The Hyaluronidases: Their Genomics, Structures, and Mechanisms of Action," Chem. Rev. 106:818-839 (2006).

Steipe, "Consensus-Based Engineering of Protein Stability: From Intrabodies to Thermostable Enzymes," Methods in Enzymology, 388:176-186 (2004).

Sills, "Retraction," Science, 319:569 (2008).

Jedzrejas et al., "Structures of Vertebrate Hyaluronidases and Their Unique Enzymatic Mechanism of Hydrolysis," Proteins: Structure, Function and Bioinformatics, 61:227-238 (2005).

Schwede et al., "Swiss-Model: An Automated Protein Homology-Modeling Server," Nucleic Acids Rsch., 31:3381-3385 (2003).

Ruan et al., "Design and Characterization of a Protein Fold Switching Network," Nature Comm., 14 (2023).

JP2021-567961—Decision to Grant a Patent mailed on Oct. 8, 2024, 7 pages.

AU2021320569—Notice of Acceptance mailed on Sep. 20, 2024, 4 pages.

Redline Comparison of U.S. Appl. No. 13/694,731 application (Exhibit 1026 in PGR2025-00003) and U.S. Pat. No. 11,952,600 Patent (Exhibit 1001 in PGR2025-00003) Specifications.

JP2023026863—Decision of Refusal mailed on Oct. 8, 2024, 4 pages.

Ph20_pre2011 Alignment html (Exhibit 1058 in PGR2025-00003).

Ph20_pre2011.aln-clustal_num (Exhibit 1057 in PGR2025-00003).

Primakoff et al., "Reversible Contraceptive Effect of PH-20 Immunization in Male Guinea Pigs," Biol Reprod., 56(5):1142-6 (1997).

R.D. Harvey, et al., "Early results of pegvorhyaluronidase alfa (PEGPH20; PVHA) + pembrolizumab therapy in patients (Pts) with relapsed/refractory gastric/gastroedophageal junction (GEJ) adenocarcinoma", Annals of Oncology, vol. 29, Supplement 9, Nov. 2018, 1 page.

AU2023200324—Examination Report No. 1 mailed on Aug. 22, 2024, 2 pages.

Kegg, Drug: Hyaluronidase (human recombinant), available at: https://www.genome.jp/entry/D06604, accessed Oct. 5, 2024.

KR20207024813—Request for the Submission of an Opinion mailed on Jul. 30, 2024, 14 pages.

Merck Sharp & Dohme, LLC, Relative Bioavailability Study of Subcutaneous Injection Versus Intravenous Infusion of Pembrolizumab (MK-3475) in participants with advanced melanoma (MK-3475-555/KEYNOTE-555), National Library of Medicine: National Center for Biotechnology Information, 2023, pp. 1-20.

Mihel, "PSAIA—Protein Structure and Interaction Analyzer," BMC Structural Biology, 8:21 (2008).

Baba et al., "Mouse Sperm Lacking Cell Surface Hyaluronidase PH-20 Can Pass through the Layer of Cumulus Cells and Fertilize the Egg," J. Biol. Chem., 277(33):30310-4 (2002).

Beasley & Hecht, "Protein Design: The Choice of de Novo Sequences," J. Biological Chemistry, 272:2031-2034 (1997).

KR20240036308—Written Decision on Registration mailed on Sep. 2, 2024, 6 pages.

Leisola & Turunen, "Protein Engineering: Opportunities and Challenges," Appl. Microbiol. Biotechnol. 75:1225-1232 (2007).

Lins et al., "Analysis of Accessible Surface of Residues in Proteins," Protein Sci., 12:1406-1417 (2003).

Studies of Peptides and Proteins, Biophysical J. 75:422-427.

Bordoli et al., "Protein structure homology modeling using SwissModel workspace," Nature Protocols, 4(1):1-13 (2008).

BR1120200190411—Office Action mailed on Oct. 15, 2024, 8 pages.

Petition for Post Grant Review filed Nov. 12, 2024 in Case No. PGR2025-00003, U.S. Pat. No. 11,952,600.

Brandon & Tooze, "Introduction to Protein Structure," Second Ed., Chapters 1-6, 11-12, 17-18 (1999).

Butler M., "Optimisation of the Cellular Metabolism of Glycosylation for Recombinant Proteins Produced by Mammalian Cell Systems", Cytotechnology, vol. 50, No. 1-3, Jun. 9, 2006, pp. 57-76.

He, et al., "NMR Structures of Two Designed Proteins with High Sequence Identity but Different Fold and Function," PNAS, 105:14412-14417 (2008).

Pomering et al., "Restricted Entry of IgG into Male and Female Rabbit Reproductive Ducts Following Immunization with Recombinant Rabbit PH-20," Am. J. Reprod. Immunol., (3):174-82.

Rosengren et al., "Clinical Immunogenicity of rHuPH20, a Hyaluronidase Enabling Subcutaneous Drug Administration," AAPS J., 17:1144-1156 (2015).

Rosengren et al., "Recombinant Human PH20: Baseline Analysis of the Reactive Antibody Prevalence in the General Population Using Healthy Subjects," BioDrugs, 32(1):83-89 (2018).

Gmachl et al., "The human sperm protein PH-20 has hyaluronidase activity," FEBS Letters, 3:545-548 (1993).

EP21853474.1—Extended European search report mailed on Jul. 31, 2024, 14 pages.

Sievers et al., "Fast, Scalable Generation of High-Quality Protein Multiple Sequence Alignments Using Clustal Omega," Molecular Sys. Biology, 7.1 (2011).

Declaration of Michael Hecht, Ph.D. Executed Nov. 12, 2024, Case No. PGR2025-00003, U.S. Pat. No. 11,952,600 (Exhibit 1003 in PGR2025-00003).

U.S. Appl. No. 61/796,208.

Declaration of Dr. Sheldon Park Executed Nov. 8, 2024, Case No. PGR2025-00003, U.S. Pat. No. 11,952,600 (Exhibit 1004 in PGR2025-00003).

Swiss Model Printout of PH20 Model, printed Nov. 10, 2024 (Exhibit 1069 in PGR2025-00003).

TW112123526—Second Office Action mailed on Sep. 6, 2024, 6 pages.

Swiss Model Printout of PH20 Model with D320R Mutation, printed Nov. 9, 2024 (Exhibit 1072 in PGR2025-00003).

(56)                  References Cited

OTHER PUBLICATIONS

Collection of PyMol Webpages from the Internet Archive, navigable from: https://web.archive.org/web/20110701072314/http://pymol. org/, accessed Nov. 7, 2024.

Declaration of Jeffrey P. Kushan dated Nov. 12, 2024, Case No. PGR2025-00003 U.S. Pat. No. 11,952,600 (Exhibit 1068 in PGR2025-00003).

U.S. Appl. No. 17/608,729—Requirement for Restriction/Election mailed on May 14, 2024, 5 pages.

Merck Sharp & Dohme LLC, et al. "Phase II Study of PEGPH20 and Pembrolizumab (MK-3475) for Patients With Previously Treated Hyaluronan High (HA-High) Metastatic Pancreatic Ductal Adenocarcinoma," Clinical Trails NCT03634332, Protocol ID PCRT 16-001, Version 1 (Aug. 14, 2018).

Merck Sharp & Dohme LLC, et al. "Phase II Study of PEGPH20 and Pembrolizumab (MK-3475) for Patients With Previously Treated Hyaluronan High (HA-High) Metastatic Pancreatic Ductal Adenocarcinoma," Clinical Trails NCT03634332, Protocol ID PCRT 16-001, Version 2 (Aug. 16, 2018).

Merck Sharp & Dohme LLC, et al. "Phase II Study of PEGPH20 and Pembrolizumab (MK-3475) for Patients With Previously Treated Hyaluronan High (HA-High) Metastatic Pancreatic Ductal Adenocarcinoma," Clinical Trails NCT03634332, Protocol ID PCRT 16-001, Version 3 (May 3, 2019).

Bristol-Myers Squibb "A Phase 3, Open-label, Randomized, Noninferiority Trial of Subcutaneous Formulation of Nivolumab Versus Intravenous Nivolumab in Participants With Advanced or Metastatic Clear Cell Renal Cell Carcinoma Who Have Received Prior Systemic Therapy," Clinical Trails NCT04810078, Protocol ID CA209-67T, Version 1 (Mar. 19, 2021).

Kuhn et al., "Biopharmaceutical Composition Ed", ip.com, IP.Com Inc., West Henrietta, NY, US, Jul. 12, 2019, 723-726 (Jul. 12, 2019).

Humphrey J H et al., "International standard for hyaluronidase", Switzerland Jan. 1, 1957 (Jan. 1, 1957), p. 291-294.

Connor Robert J. et al., "A Preclinical Investigation into the Effects of Aging on Dermal Hyaluronan Properties and Reconstitution Following Recombinant Human Hyaluronidase PH20 Administration", May 2, 2020 (May 2, 2020), vol. 10, No. 3, p. 503-513.

Wang Wei Ed—Blanco-Prieto Maria J et al., "Instability, stabilization, and formulation of liquid protein pharmaceuticals", International Journal of Pharmaceutics, Elsevier, NL, vol. 185, No. 2, Aug. 20, 1999 (Aug. 20, 1999), p. 129-188.

Falconer Robert J., "Advances in liquid formulations of parenteral therapeutic proteins", Biotechnology Advances., vol. 37, No. 7, Nov. 1, 2019 (Nov. 1, 2019), p. 1-29.

Patnaik et al., Phase I Study of Pembrolizumab (MK-3475; Anti-PD-1 Monoclonal Antibody) in Patients with Advanced Solid Tumors, Clinical Cancer Research, May 14, 2015 [retrieved Nov. 2, 2023]. Retrieved from the Internet <URL: https :1/aacrjournals.org/clincancerres/article/21/19/4286/125563/Phase-I-Study-of-Pembrolizumab-MK-3475-Anti-PD-1>.

Johnson et al., "Assessment of Subcutaneous vs Intravenous Administration of Anti-PD-1 Antibody PF-06801591 in Patients With Advanced Solid Tumors," JAMA Oncology 5(7):999-1007.

Bristol-Myers Squibb "Phase I/II Pharmacokinetic Multi-Tumor Study of Subcutaneous Formulation of Nivolumab Monotherapy," Clinical Trails NCT03656718, Protocol ID CA209-8KX, Version 1 (Aug. 31, 2018).

Thompson et al., "Enzymatic Depletion of Tumor Hyaluronan Induces Antitumor Responses in Preclinical Animal Models," Molecular Cancer Therapeutics 9(11):3052-3064 (2010).

Gong et al., "Combination systemic therapies with immune checkpoint inhibitors in pancreatic cancer: overcoming resistance to single-agent checkpoint blockade," Clinical and Transitional Medicine 7(32):1-16 (2018).

Kumar et al., "Emerging Therapies in the Management of Advanced-Stage Gastric Cancer," Frontiers in Pharmacology Review 13(9):1-24 (2018).

* cited by examiner

[Fig. 2]

Fig. 3 (Continued)
(D)
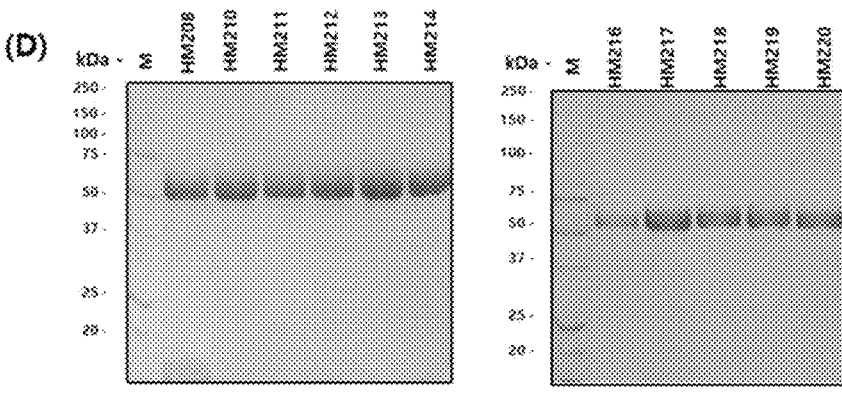
(E)
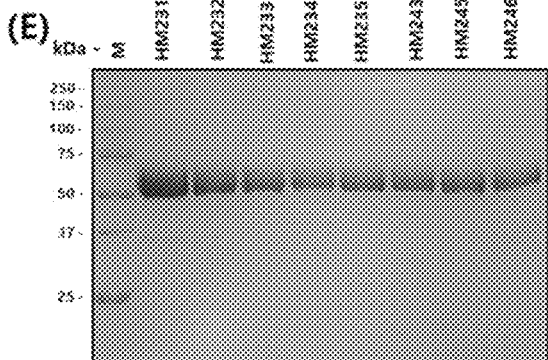
(F)
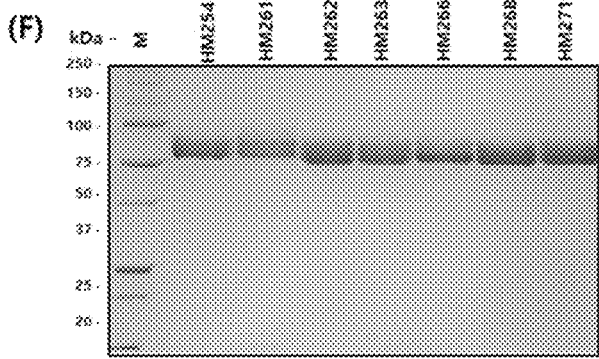
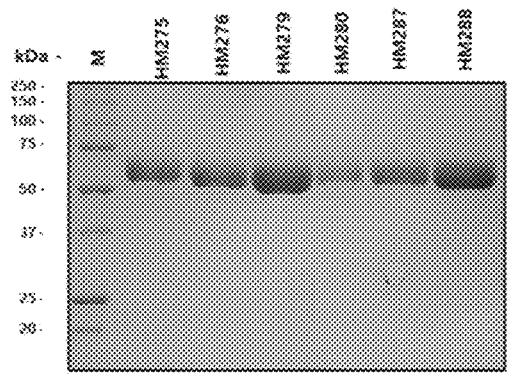

[Fig. 4]
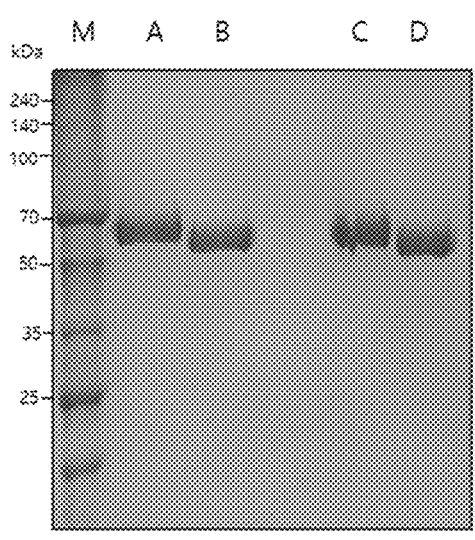 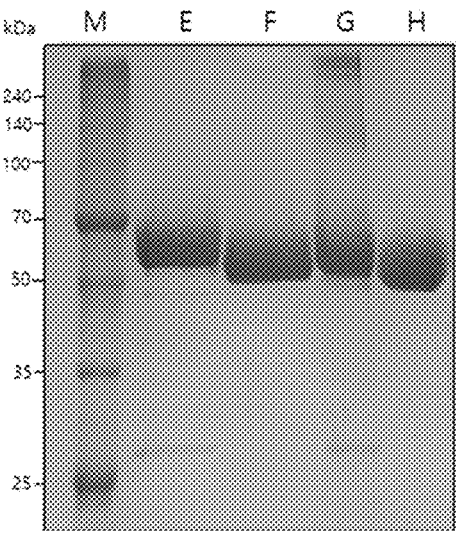

HYALURONIDASE VARIANTS WITH IMPROVED STABILITY AND PHARMACEUTICAL COMPOSITION COMPRISING THE SAME

CROSS-REFERENCE TO RELATED APPLICATIONS

This is a U.S. national phase under 35 USC § 371 of International Patent Application No. PCT/KR2021/000943 filed Jan. 25, 2021, which in turn claims priority under 35 USC § 119 of Korean Patent Application No. 10-2020-0009046 filed Jan. 23, 2020. The disclosures of all such applications are hereby incorporated herein by reference in their respective entireties, for all purposes.

REFERENCE TO SEQUENCE LISTING SUBMITTED VIA EFS-WEB

This application includes an electronically submitted sequence listing in .txt format. The .txt file contains a sequence listing entitled "Q303377_SeqListing ST25.txt" created on Aug. 11, 2025 and is 630,784 bytes in size. The sequence listing contained in this .txt file is part of the specification and is hereby incorporated by reference herein in its entirety.

BACKGROUND OF THE INVENTION

Field of the Invention

The present invention relates to novel human PH20 variants or fragments thereof having increased enzymatic activity and thermal stability compared to human hyaluronidase, which is an enzyme that hydrolyzes hyaluronic acid, and more particularly to PH20 variants or fragments thereof, which include one or more amino acid residue substitutions, deletions and/or insertions in hyaluronidase variants having the amino acid sequence of SEQ ID NO: 3, and optionally in which one or more amino acid residues are deleted from the N-terminus and/or C-terminus, a method for producing the same, and a pharmaceutical composition containing the same.

Description of the Related Art

The human skin is composed of the epidermis, the dermis, and a subcutaneous fat layer, and there are six types of glycosaminoglycans in the skin. These glycosaminoglycans include hyaluronic acid, chondroitin sulfate, dermatan sulfate, heparan sulfate, heparin, and keratin sulfate.

These glycosaminoglycans are composed of repeating disaccharide sugar units. The number of repeating disaccharide sugar units is different among glycosaminoglycans, but ranges from several hundreds to several thousands. Among the glycosaminoglycans, hyaluronic acid is present in the skin more than half of the amount in the body. Hyaluronic acid is synthesized by hyaluronan synthase present in the cell membrane, is present alone without binding to proteoglycans, and is the only glycosaminoglycan having no sulfate group. Other glycosaminoglycans bind to proteoglycans and have a sulfate group. Hyaluronic acid consists of glucuronic acid and N-acetylglucosamine, alternately linked via β-1,4 and β-1,3 bonds, and is composed of about 5,000 repeating units of these disaccharides. It is known that about one-third (5 g) of hyaluronic acid in the human body is degraded every day.

Hyaluronidases are enzymes that degrade hyaluronic acid present in the extracellular matrix. Six hyaluronidase genes are known in humans: Hyal1, Hyal2, Hyal3, Hyal4, HyalPS1, and PH20/SPAM1. Human Hyal1 and Hyal2 are expressed in most tissues. PH20/SPAM1 (hereinafter referred to as PH20) is expressed in the sperm plasma membrane and the acrosomal membrane. However, HyalPS1 is not expressed, because it is a pseudogene. Hyaluronidases are divided, depending on the method by which hyaluronic acid is cleaved, into three types: enzymes (EC 3.2.1.35) that cleave β-1,4 bonds between N-acetylglucosamine and glucuronic acid by the use of $H_2O$; enzymes (EC 3.2.1.36) that cleave β-1,3 bonds between N-acetylglucosamine and glucuronic acid by the use of $H_2O$; and bacterial hyaluronidases (EC 4.2.99.1) that cleave β-1,4 bonds without using $H_2O$.

The catalytic amino acids of Hyal1 are D129 and E131, which hydrolyze hyaluronic acid by substrate-assisted catalysis. Hyal1 exhibits optimum activity at an acidic pH of 3 to 4, and has no enzymatic activity at a pH of 4.5 or higher. In contrast to Hyal1, PH20 exhibits activity throughout a wide pH range of 3 to 8.

Arming et al. identified that the catalytic amino acids of PH20 are D111 and E113 (Arming et al., 1997). Arming et al. designated Leu as the first amino acid of the PH20, from which a signal peptide or the like is removed, and thus the catalytic amino acids of the PH20 containing the signal peptide correspond to D146 and E148, respectively.

Hyaluronidase hydrolyzes hyaluronic acid, thereby reducing the viscosity of hyaluronic acid in the extracellular matrix and increasing the permeability thereof into tissue (skin). The subcutaneous area of the skin has a neutral pH of about 7.0 to 7.5. Thus, among various types of hyaluronidases, PH20 is widely used in clinical practice (Bookbinder et al., 2006). In examples in which PH20 is used in clinical practice, PH20 is used as an eye relaxant and an anesthetic additive in ophthalmic surgery, and is also co-administered with an antibody therapeutic agent which is injected subcutaneously (Bookbinder et al., 2006). In addition, based on the property of hyaluronic acid, which is overexpressed in tumor cells, PH20 is used to hydrolyze hyaluronic acid in the extracellular matrix of tumor cells, thereby increasing the access of an anticancer therapeutic agent to the tumor cells. In addition, it is also used to promote resorption of body fluids and blood, which are excessively present in tissue.

PH20 was first identified in guinea pig sperm by Lathrop et al., and is also known to be expressed in sperm of different species. Human PH20 gene was cloned by Lin et al. and Gmachl et al. Human PH20 has the amino acid sequence of SEQ ID NO: 1, which consists of 509 amino acid residues, and exhibits 60% amino acid identity with guinea pig PH20 gene. Human PH20 enzyme is encoded from the SPAM1 (sperm adhesion molecule-1) gene, and Ser490 of PH20 is present in the form of being bound to glycosylphosphatidylinositol (GPI) on the surface of the sperm plasma membrane and in the acrosomal membrane. Sperm hydrolyzes hyaluronic acid using PH20 when it penetrates oocytes through the hyaluronan-rich cumulus layer of the oocytes. PH20 is present in an amount corresponding to 1% or less of the amount of proteins in sperm, and has six N-glycosylation sites (N82, N166, N235, N254, N368, and N393).

Currently commercially available PH20 is obtained by extraction from the testes of cattle or sheep. Examples thereof include AMPHADASE® (bovine hyaluronidase) and VITRASE® (sheep hyaluronidase).

Bovine testicular hyaluronidase (BTH) is obtained by removing a signal peptide and 56 amino acids on the C-terminal from bovine wild-type PH20 during post-translational modification. BTH is also a glycoprotein, and has a mannose content of 5% and a glucosamine content of 2.2% based on the total components including amino acids. When animal-derived hyaluronidase is repeatedly administered to the human body at a high dose, a neutralizing antibody can be produced. Since animal-derived hyaluronidase contains other biomaterials in addition to PH20, it may cause an allergic reaction when administered to the human body (Bookbinder et al., 2006). In particular, the production and the use of PH20 extracted from cattle can be limited due to concerns of mad cow disease. In order to overcome this problem, studies on the recombinant protein of human PH20 have been conducted.

Recombinant protein of human PH20 has been reported to be expressed in yeast (P. pastoris), DS-2 insect cells, and animal cells. The recombinant PH20 proteins produced in insect cells and yeast differ from human PH20 in terms of the pattern of N-glycosylation during post-translational modification.

Hyaluronidases, protein structures of which have been identified are Hyal1 (PDB ID: 2PE4) (Chao et al., 2007) and bee venom hyaluronidase (PDB ID: 1FCQ, 1FCU, 1FCV). Hyal1 is composed of two domains, a catalytic domain and an EGF-like domain. The catalytic domain is in the form of $(\beta/\alpha)_8$ in which an alpha-helix and a beta-strand, which characterize the secondary structure of the protein, are each repeated eight times (Chao et al., 2007). The EGF-like domain is completely conserved in variants in which the C-terminus of Hyal1 is spliced differently. The amino acid sequences of Hyal1 and PH20 are 35.1% identical, and the protein structure of PH20 has not yet been found.

A recombinant protein of human PH20 was developed by HALOZYME THERAPEUTIC, INC. and has been sold under the trade name HYLENEX® (Bookbinder et al., 2006; Frost, 2007).

When D146 and E148, which are the catalytic amino acids of PH20, were mutated to asparagine (D146N) and glutamine (E148Q), respectively, there was no enzymatic activity (Arming et al., 1997). In addition, when R246 of PH20 was substituted with glycine, the enzymatic activity was reduced by 90%, and when E319 was substituted with glutamine and R322 was substituted with threonine, the enzymatic activity disappeared. A variant in which 36 amino acids at the C-terminus of PH20 were removed (truncation of amino acids 474-509) exhibited a 75% reduction in enzymatic activity compared to wild-type PH20. This mutant was not secreted extracellularly, but remained in HeLa cells. A mutant in which C-terminal 134 amino acids were removed from PH20 had no enzymatic activity and was not secreted extracellularly. According to Frost et al., the C-terminal 477-483 region of PH20 is essential for soluble expression (Frost, 2007). The activity of full-length PH20 (1-509) or a PH20 variant having a C-terminus truncated at position 467 was merely 10% of a PH20 variant having a C-terminus truncated at one of positions 477 to 483 (Frost, 2007).

Recombinant PH20 is medically used as a carrier to promote subcutaneous delivery of pharmaceuticals, to reduce intraocular pressure in patients with ophthalmic diseases, to delay stenosis after surgery, as a dispersant to improve the activity of chemotherapeutic agents in diseases such as cancer, as an auxiliary therapeutic agent for surgery, and the like.

In particular, in the case of protein drugs, recently, high-dose products with high concentrations ranging from tens of mg to hundreds of mg per 1 mL have been developed, and thus the application of recombinant PH20 as a carrier to promote subcutaneous delivery of such protein drugs is increasing. Such protein drugs may have problems of low physical stability resulting from an increase in viscosity and aggregation of proteins due to the high concentration thereof. In addition, the aggregation of proteins is irreversible, and small amounts of proteins start to aggregate and aggregate form larger clumps (Schon et al., 2015). That is, recombinant PH20 administered in combination undergoes aggregation, thus reducing the stability of protein drugs.

Meanwhile, conventional recombinant PH20 is still insufficient from the aspects of thermal stability and expression level. Therefore, there is great demand in industry for a recombinant hyaluronidase having further improved biological and physico-chemical properties.

REFERENCE

Arming, S., Strobl, B., Wechselberger, C., and Kreil, G. (1997). In-vitro mutagenesis of PH-20 hyaluronidase from human sperm. Eur. J. Biochem. 247, 810-814.

Bookbinder, L. H., Hofer, A., Haller, M. F., Zepeda, M. L., Keller, G. A., Lim, J. E., Edgington, T. S., Shepard, H. M., Patton, J. S., and Frost, G. I. (2006). A recombinant human enzyme for enhanced interstitial transport of therapeutics. J. Control. Release 114, 230-241.

Chao, K. L., Muthukumar, L., and Herzberg, O. (2007). Structure of human hyaluronidase-1, a hyaluronan hydrolyzing enzyme involved in tumor growth and angiogenesis. Biochemistry 46, 6911-6920.

Frost, G. I. (2007). Recombinant human hyaluronidase (rHuPH20): an enabling platform for subcutaneous drug and fluid administration. Expert Opin. Drug Deliv. 4, 427-440. Schön, A., Clarkson, B. R., Siles, R., Ross, P., Brown, R. K., Freire, E. (2015) Denatured state aggregation parameters derived from concentration dependence of protein stability. Anal. Chem. 488, 45-50

WO 2020/022791A (2020 Jan. 30.)

SUMMARY OF THE INVENTION

Therefore, the present invention has been made in view of the above problems, and it is one object of the present invention to provide a PH20 variant or fragment thereof which is improved in thermal stability, enzyme activity and expression level, compared to wild-type PH20, preferably mature wild-type PH20.

It is another object of the present invention to provide a composition for treating cancer containing the PH20 variant or fragment thereof and a method of treating cancer using the same.

In accordance with one aspect of the present invention, the above and other objects can be accomplished by the provision of a PH20 variant or fragment thereof comprising one or more amino acid residue substitutions, deletions and/or insertions in a hyaluronidase variant having the amino acid sequence of SEQ ID NO: 3, and in which one or more amino acid residues at the N-terminus or C-terminus are selectively deleted.

In accordance with another aspect of the present invention, there are provided a composition for treating cancer containing the PH20 variant or fragment thereof and a method of treating cancer using the same.

Effects of the Invention

The PH20 variants or fragments thereof according to the present invention have increased protein expression levels and show an increase in protein aggregation temperature of 4-11.5° C. or so when expressed in CHO (EXPICHO™) cells so that they are efficiently produced and are imparted with higher thermal stability compared to the mature wild-type PH20.

Further, as the result of a substrate-gel assay, one of tests to measure the activity of hyaluronidase, the PH20 variants or fragments thereof according to the present invention have improved protein refolding so that they are re-natured faster than the mature wild-type PH20, and the original enzymatic activity is maintained regardless of the C-terminal cleavage position.

Furthermore, the PH20 variants or fragments thereof according to the present invention have low immunogenicity, so that they can be repeatedly administered to the human body.

BRIEF DESCRIPTION OF THE DRAWINGS

The above and other objects, features and other advantages of the present invention will be more clearly understood from the following detailed description taken in conjunction with the accompanying drawings, in which.

Figure 1:
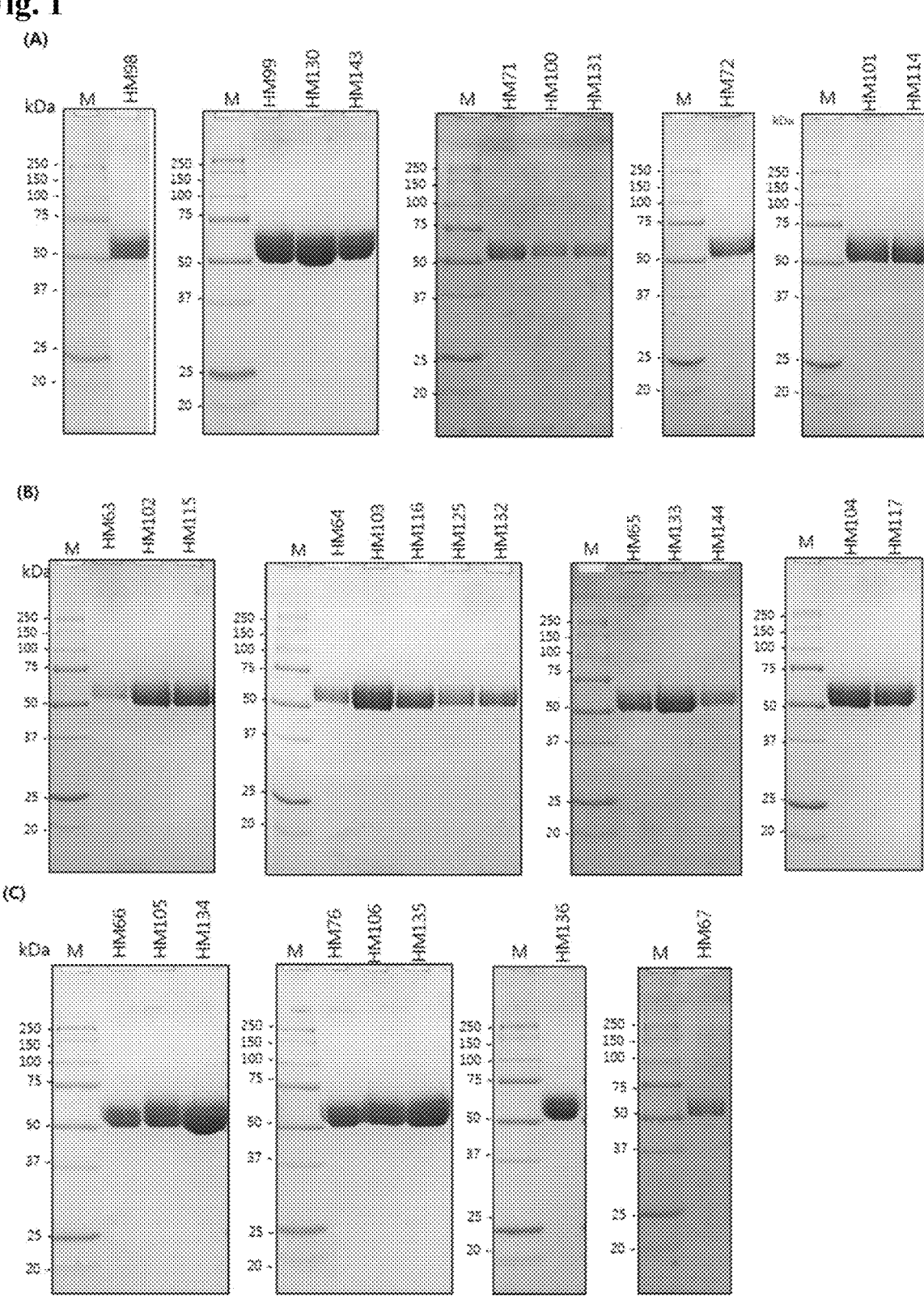
FIG. 1 shows the results of SDS-PAGE analysis of various variants based on a PH20 variant having the amino acid sequence of SEQ ID NO: 3. The result of the following SDS-PAGE analysis regarding each variant is obtained by purifying an animal cell culture solution expressing each variant through column chromatography and performing 10% SDS-PAGE analysis on the final purified variant.
Figure 1:
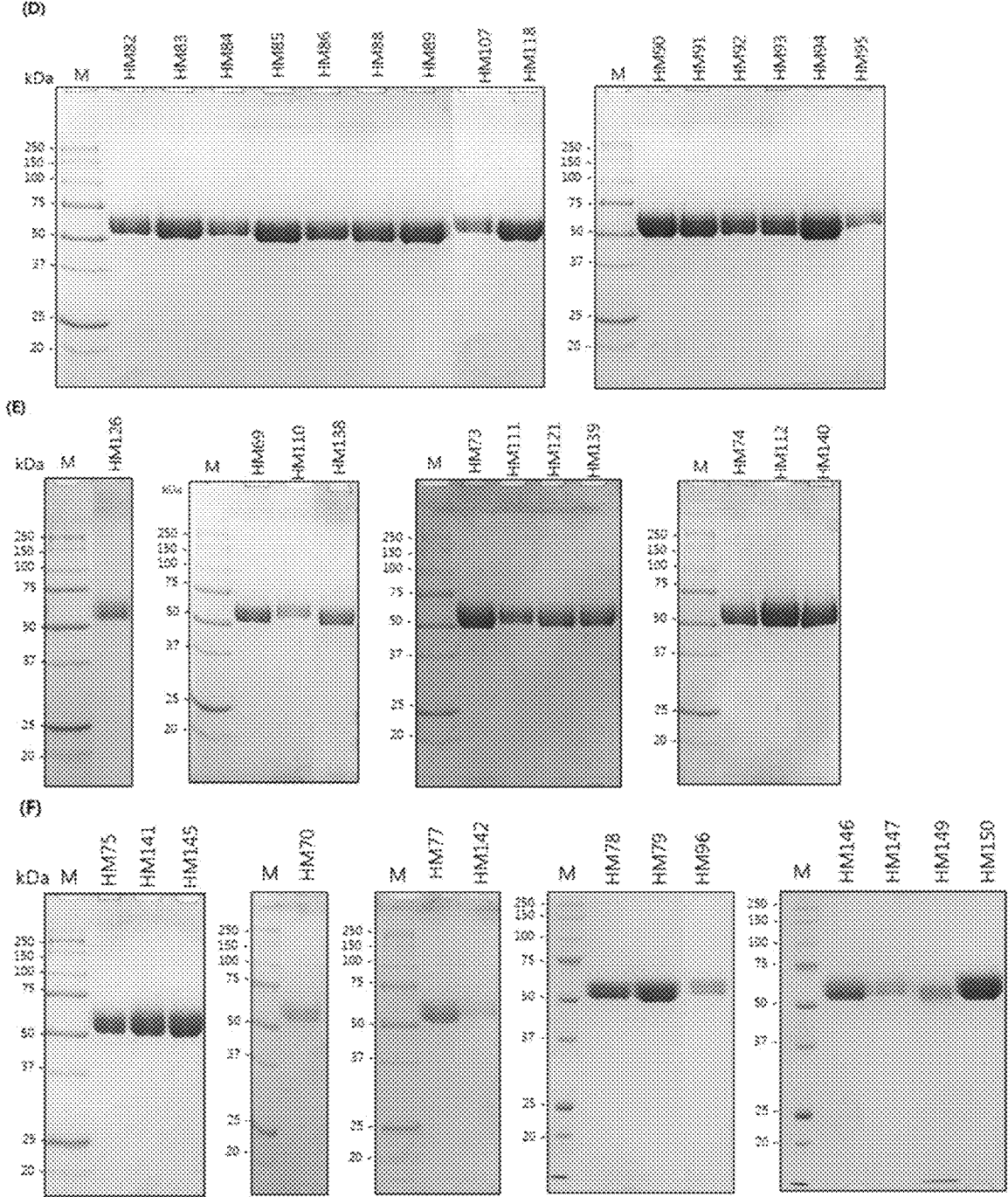
Figure 2:
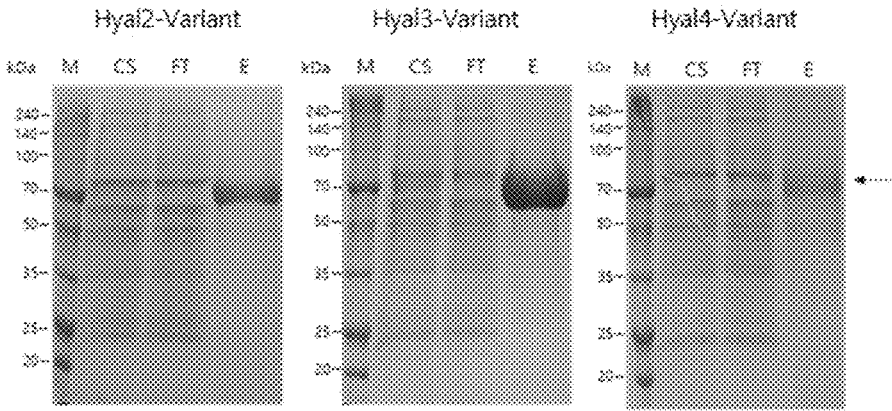
Figure 3:
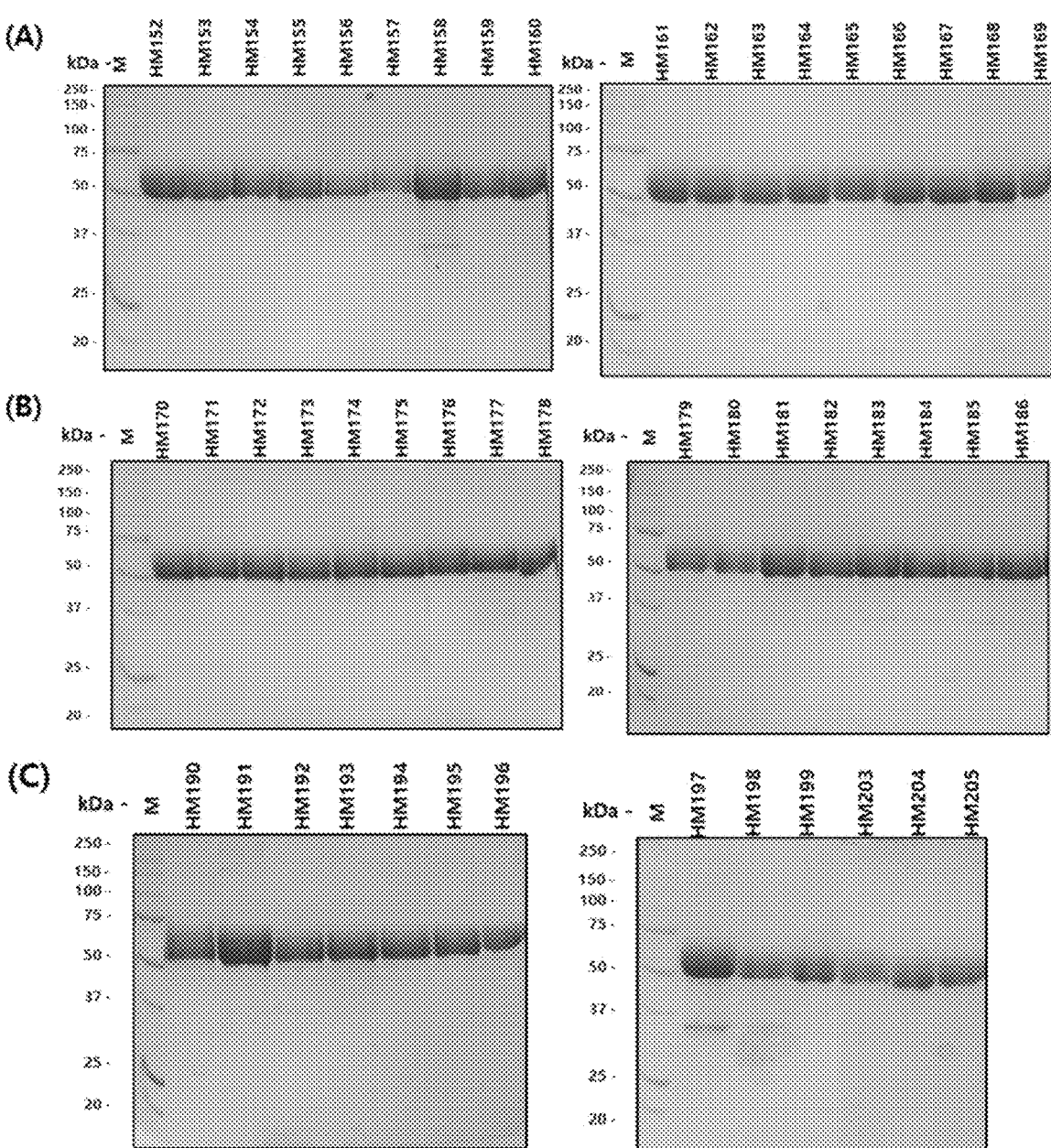

More specifically, FIG. 1 in part (A) thereof shows the results of SDS-PAGE regarding variants HM98, HM99, HM130, HM143, HM71, HM100, HM131, HM72, HM101, and HM114;

FIG. 1 in part (B) thereof shows the results of SDS-PAGE regarding variants HM63, HM102, HM115, HM64, HM103, HM116, HM125, HM132, HM65, HM133, HM144, HM104 and HM117;

FIG. 1 in part (C) thereof shows the results of SDS-PAGE gel regarding variants HM66, HM105, HM134, HM76, HM106, HM135, HM136 and HM67;

FIG. 1 in part (D) thereof shows the results of SDS-PAGE regarding variants HM82, HM83, HM84, HM85, HM86, HM88, HM89, HM107, HM118, HM90, HM91, HM92, HM93, HM94 and HM95;

FIG. 1 in part (E) thereof shows the results of SDS-PAGE regarding variants HM73, HM111, HM121, HM139, HM74, HM112 and HM140;

FIG. 1 in part (F) thereof shows the results of SDS-PAGE regarding variants HM75, HM141, HM145, HM70, HM77, HM142, HM78, HM79, HM96, HM146, HM147, HM149 and HM150;

FIG. 2 shows the expressions levels of a mature wild-type PH20 and a Hyal2-variant, a Hyal3-variant and a Hyal4-variant in which the region M345 to 1361 of the mature wild-type PH20 was substituted with corresponding sequences of Hyal2, Hyal3 and Hyal4, respectively, wherein Lane CS of SDS-PAGE is a culture medium sample, Lane FT is an unbound impurity in a HisTag column, and Lane E is a HisTag column eluate;

FIG. 3 shows the results of SDS-PAGE analysis of various variants based on a PH20 variant having the amino acid sequence of SEQ ID NO: 3. The result of the following SDS-PAGE analysis regarding each variant is obtained by purifying an animal cell culture solution expressing each variant through column chromatography and performing 10% SDS-PAGE analysis on the final purified variant;

FIG. 3 in part (A) thereof shows the results of SDS-PAGE regarding variants HM152, HM153, HM154, HM155, HM156, HM157, HM158, HM159, HM160, HM161, HM162, HM163, HM164, HM165, HM166, HM167, HM168 and HM169;

FIG. 3 in part (B) thereof shows the results of SDS-PAGE regarding variants HM170, HM171, HM172, HM173, HM174, HM175, HM176, HM177, HM178, HM179, HM180, HM181, HM182, HM183, HM184, HM185 and HM186;

FIG. 3 in part (C) thereof shows the results of SDS-PAGE regarding variants HM190, HM191, HM192, HM193, HM194, HM195, HM196, HM197, HM198, HM199, HM203, HM204 and HM205;

FIG. 3 in part (D) thereof shows the results of SDS-PAGE regarding variants HM208, HM210, HM211, HM212, HM213, HM214, HM216, HM217, HM218, HM219 and HM220;

FIG. 3 in part (E) thereof shows the results of SDS-PAGE regarding variants HM231, HM232, HM233, HM234, HM235, HM243, HM245 and HM246;

FIG. 3 in part (F) thereof shows the results of SDS-PAGE regarding variants HM254, HM261, HM262, HM263, HM266, HM268, HM271, HM275, HM276, HM279, HM280, HM287 and HM288; and FIG. 4 shows the results of SDS-PAGE confirming the thermostability of wild-type PH20 (L36-Y482) and variant PH20 (F38-F468) having the amino acid sequence of SEQ ID NO: 3, wherein Lanes A, B, C and D show the results of SDS-PAGE analysis regarding initial wild-type PH20 (Lanes A and C) and the PH20 variant of SEQ ID NO: 3 (Lanes B and D) in a reduced form (Lanes A and B) and a non-reduced form (Lanes C and D), and Lanes E, F, G and H show the results of SDS-PAGE analysis regarding initial wild-type PH20 (Lanes E and G) and variant PH20 of SEQ ID NO: 3 (Lanes F and H) in a reduced form (Lanes E and F) and a non-reduced form (Lanes G and H) after being stored for 7 days at 42° C.

DETAILED DESCRIPTION OF THE INVENTION

Unless defined otherwise, all technical and scientific terms used herein have the same meanings as appreciated by those skilled in the field to which the present invention pertains. In general, the nomenclature used herein is well-known in the art and is ordinarily used.

In the present invention, the position of the amino acid residue of each variant is referred from the amino acid sequence according to SEQ ID NO: 1, when described based on wild-type PH20, and the position of the amino acid residue of each variant is referred from the amino acid sequence according to SEQ ID NO: 3, when described based on the PH20 variant having SEQ ID NO: 3.

The present inventors found through previous research that a hyaluronidase PH20 variant, which includes one or more amino acid residue substitutions in the region corresponding to an alpha-helix region and/or a linker region thereof, preferably an alpha-helix 8 region (S347 to C381) and/or a linker region (A333 to R346) between alpha-helix 7 and alpha-helix 8, in wild-type PH20 having an amino acid sequence of SEQ ID NO: 1, preferably mature wild-type PH20, and optionally in which one or more of the N-terminal and/or C-terminal amino acid residues are selectively cleaved and deleted, exhibits superior efficacy compared to conventional wild-type PH20 or fragments thereof, and filed a patent application regarding this finding (see WO 2020/022791A).

As used herein, the term "mature wild-type PH20" means a protein consisting of amino acid residues L36 to Y482 or L36 to S490 of SEQ ID NO: 1, which lack M1 to T35, which form a signal peptide, and N483 to L509 or A491 to L509, which are not related to the substantial enzymatic function of PH20, in the amino acid sequence of SEQ ID NO: 1 of wild-type PH20.

Specifically, the present inventors found through previous research that, when amino acid sites corresponding to T341 to I361, which is a part of an alpha-helix 8 region (S347 to C381) and/or a linker region (A333 to R346) between alpha-helix 7 and alpha-helix 8, in wild-type PH20 having an amino acid sequence of SEQ ID NO: 1 is substituted with amino acid residues corresponding to wild-type Hyal1 having the sequence of SEQ ID NO: 2, the expression efficiency and enzymatic activity are improved, and fragments in which a part of the amino acid sequence at the N-terminus and C-terminus is deleted also exhibit superior expression efficiency and high enzymatic activity.

TABLE 1

Amino acid sequence of wild-type PH20 and wild-type Hyal1

Amino acid sequence of wild-type PH20 (SEQ ID NO: 1)

MGVLKFKHIFFRSFVKSSGVSQIVFTFLLIPCCLTLNFRAPPVIPNVPFL
WAWNAPSEFCLGKFDEPLDMSLFSFIGSPRINATGQGVTIFYVDRLGYYP
YIDSITGVTVNGGIPQKISLQDHLDKAKKDITFYMPVDNLGMAVIDWEEW
RPTWARNWKPKDVYKNRSIELVQQQNVQLSLTEATEKAKQEFEKAGKDFL
VETIKLGKLLRPNHLWGYYLFPDCYNHHYKKPGYNGSCENVEIKRNDDLS
WLWNESTALYPSTYLNTQQSPVAATLYVRNRVREAIRVSKIPDAKSPLPV
FAYTRIVFTDQVLKFLSQDELVYTFGETVALGASGIVIWGTLSIMRSMKS
CLLLDNYMETILNPYIINVTLAAKMCSQVLCQEQGVCIRKNWNSSDYLHL
NPDNFAIQLEKGGKFTVRGKPTLEDLEQFSEKFYCSCYSTLSCKEKADVK
DTDAVDVCIADGVCIDAFLKPPMETEEPQIFYNASPSTLSATMFIVSILF
LIISSVASL

Amino acid sequence of wild-type Hyal1 (SEQ ID NO: 2)

MAAHLLPICALFLTLLLDMAQGFRGPLLPNRPFTTVWNANTQWCLERHGVD
VDVSVFDVVANPGQTFRGPDMTIFYSSQLGTYPYYTPTGEPVFGGLPQNA
SLIAHLARTFQDILAAIPAPDFSGLAVIDWEAWRPRWAFNWDTKDIYRQR
SRALVQAQHPDWPAPQVEAVAQDQFQGAARAWMAGTLOLGRALRPRGLWG
FYGFPDCYNYDFLSPNYTGQCPSGIRAQNDQLGWLWGQSRALYPSIYMPA
VLEGTGKSQMYVQHRVAEAFRVAVAAGDPNLPVLPYVQIFYDTTNHFLPL
DELEHSLGESAAQGAAGVVLWVSWENTRTKESCQAIKEYMDTTLGPFILN
VTSGALLCSQALCSGHGRCVRRTSHPKALLLLNPASFSIQLTPGGGPLSL
RGALSLEDQAQMAVEFKCRCYPGWQAPWCERKSMW

As a result of continuous research, the present inventors found that a variant having the sequence of SEQ ID NO: 3, constructed by substituting the amino acid region corresponding to T341 to I361 of wild-type PH20 having the amino acid sequence of SEQ ID NO: 1 with the corresponding amino acid sequence of wild-type Hyal1 having the sequence of SEQ ID NO: 2, still exhibits excellent expression efficiency and high enzymatic activity, as well as remarkably improved protein aggregation temperature ($T_{agg}$), compared to the wild-type PH20, although it includes additional substitutions, deletions and/or insertions of amino acid residues, and further optionally includes deletions of one or more amino acid residues at the N-terminus and/or C-terminus. Based on this finding, the present invention has been completed.

The variant having the sequence of SEQ ID NO: 3 is constructed by substituting 15 amino acid residues, namely, T341S, L342W, S343E, I344N, M345T, S347T, M348K, K349E, L352Q, L353A, L354I, D355K, N356E, E359D and I361T in wild-type PH20 having the amino acid sequence of SEQ ID NO: 1.

In this regard, the PH20 variant or fragment thereof according to the present invention includes substitution, deletion and/or insertion of one or more amino acid residues in the PH20 variant having the amino acid sequence of SEQ ID NO: 3, and optionally includes deletion of one or more amino acid residues at the N-terminus and/or C-terminus.

As described above, the variant having the amino acid sequence of SEQ ID NO: 3 is a variant in which amino acid residues of T341 to I361 of wild-type PH20 are substituted with corresponding amino acid residues of wild-type Hyal1 (see Table 2). The variant having the amino acid sequence of SEQ ID NO: 3 or a fragment thereof including amino acid residue deletion at the N-terminus and C-terminus was identified as a variant having activity and stability superior to those of wild-type PH20 in previous research.

TABLE 2

Amino acid sequence of PH20 variant in which amino acid residues at positions T341 to I361 of wild-type PH20 are substituted with corresponding amino acid residues of Hyal1 (SEQ ID NO: 3)

MGVLKFKHIFFRSFVKSSGVSQIVFTFLLIPCCLTLNFRAPPVI
PNVPFLWAWNAPSEFCLGKFDEPLDMSLFSFIGSPRINATGQGV
TIFYVDRLGYYPYIDSITGVTVNGGIPQKISLQDHLDKAKKDIT
FYMPVDNLGMAVIDWEEWRPTWARNWKPKDVYKNRSIELVQQQN
VQLSLTEATEKAKQEFEKAGKDFLVETIKLGKLLRPNHLWGYYL
FPDCYNHHYKKPGYNGSCFNVEIKRNDDLSWLWNESTALYPSTY
LNTQQSPVAATLYVRNRVREAIRVSKIPDAKSPLPVFAYTRIVF
TDQVLKFLSQDELVYTFGETVALGASGIVIWGSWENTRTKESCQ
AIKEYMDTTLNPYIINVTLAAKMCSQVLCQEQGVCIRKNWNSSD
YLHLNPDNFAIQLEKGGKFTVRGKPTLEDLEQFSEKFYCSCYST
LSCKEKADVKDTDAVDVCIADGVCIDAFLKPPMETEEPQIFYNA
SPSTLSATMFIVSILFLIISSVASL

Specifically, the PH20 variant or fragment thereof according to the present invention may include one or more mutations, preferably one or more amino acid residue substitutions, deletions and/or insertions in the amino acid sequence of SEQ ID NO: 3, and has a higher protein aggregation temperature ($T_{agg}$), which is an index indicating protein stability, than the wild-type PH20. In addition, the PH20 variant according to the present invention does not include the wild-type PH20 of SEQ ID NO: 1.

As used herein, the term "PH20 variant" is intended to include a variant having not only a mutation of one or more amino acid residues, preferably substitution, deletion and/or insertion of one or more amino acid residues in the amino acid sequence of SEQ ID NO: 3, but also deletion of one or more amino acid residues at the N-terminus or C-terminus thereof together with the substitution, deletion and/or insertion of the amino acid residues, and is used with substantially the same meaning as the expression "PH20 variant or fragment thereof".

Preferably, the PH20 variant according to the present invention includes amino acid residue substitution, insertion, and/or deletion at one or more positions selected from the group consisting of R39, D65 to L68, N82, T84, I102 to I105, T132 to Y134, N166, L179 to T182, T185 to K187, V241 to K244, N266 to Q269, P271, V272, K290 to P292, Q311 to K314, G340 to N363, L441, S442, D451 to D453, D461, V463 and D461 to V463 in a variant having the amino acid sequence of SEQ ID NO: 3, and has a higher protein aggregation temperature ($T_{agg}$) than that of wild-type PH20.

The PH20 variant according to the present invention may include a mutation at 20 or fewer, preferably 17 or fewer, more preferably 15 or fewer amino acid positions in the amino acid sequence of SEQ ID NO: 3, but is not limited thereto.

More preferably, the PH20 variant or fragment thereof according to the present invention includes at least one amino acid residue substitution selected from the group consisting of R39K, D65A, E66A, P67A, L68A, N82A, T84N, I102A, D103A, S104A, S104N, I105A, I105Q, T132A, T132S, F133A, Y134A, N166A, N166K, L179A, L179S, L179I, L179F, S180T, S180A, L181A, L181M, T182A, T185A, E186A, E186D, K187A, V241A, E242A, I243A, K244A, N266A, T267A, Q268A, Q268D, Q268I, Q268N, Q269A, P271A, V272A, K290A, I291A, I291G, I291L, P292A, P292D, Q311A, V312A, L313A, L313P, L313M, K314A, G340Q, S341H, S341D, S341T, W342I, W342D, W342H, W342L, E343V, E343S, E343Y, E343Q, N344F, N344I, T345E, T345K, T345S, R346M, R346F, R346L, R346T, R346S, R346A, T347Q, T347E, T347V, T347W, T347H, T347S, K348Q, K348F, K348D, K348T, K348E, K348M, E349L, E349W, E349A, S350Q, S350I, S350D, S350T, S350E, S350N, Q352E, Q352G, Q352Y, Q352W, Q352T, A353E, A353Y, A353H, A353K, I354E, I354Q, I354S, I354V, I354A, I354N, I354T, I354R, I354W, I354L, K355Q, K355H, K355D, E356M, E356F, E356I, E356L, E356Q, E356V, E356D, Y357W, Y357F, M358V, M358R, M358Y, M358L, D359K, D359V, D359Y, D359Q, D359T, D359S, D359E, T360Y, T360R, T360L, T360D, T360S, T361M, T361E, T361H, T361L, T361D, T361I, L362A, N363M, N363E, L441A, S442A, D451A, D451S, T452A, T452D, T452H, T452K, T452G, T452P, T452M, T452F, D453A, D461R, D461A, G462A, V463Y and V463A in the variant having the amino acid sequence of SEQ ID NO: 3, but is not limited thereto.

In the present invention, an expression described by a one-letter amino acid residue code together with numbers, such as "S341", means the amino acid residue at each position in the amino acid sequence of SEQ ID NO: 1 or SEQ ID NO: 3.

For example, "S341" means that the amino acid residue at position 341 in the amino acid sequence of SEQ ID NO: 3 is serine and "S341H" means that serine at position 341 of SEQ ID NO: 3 is substituted with histidine.

The PH20 variant or a fragment thereof according to the present invention is interpreted as including variants or fragments thereof in which an amino acid residue at a specific amino acid residue position is conservatively substituted.

As used herein, the term "conservative substitution" refers to modifications of a PH20 variant that involve the substitution of one or more amino acids with other amino acids having similar biochemical properties that do not result in loss of the biological or biochemical function of the PH20 variant.

The term "conservative amino acid substitution" refers to substitution of the amino acid residue with an amino acid residue having a similar side chain. Families of amino acid residues having similar side chains have been defined and are well known in the art to which the present invention pertains. These families include amino acids with basic side chains (e.g., lysine, arginine and histidine), amino acids with acidic side chains (e.g., aspartic acid and glutamic acid), amino acids with uncharged polar side chains (e.g., asparagine, glutamine, serine, threonine, tyrosine, and cysteine), amino acids with nonpolar side chains (e.g., glycine, alanine, valine, leucine, isoleucine, proline, phenylalanine, methionine, and tryptophan), amino acids with beta-branched side chains (e.g., threonine, valine, and isoleucine), and amino acids with aromatic side chains (e.g., tyrosine, phenylalanine, tryptophan, and histidine).

It is found that the PH20 variant or fragments thereof of the present invention retains the activity thereof despite having conservative amino acid substitutions.

In addition, the PH20 variant or fragment thereof according to the present invention is interpreted to include PH20 variants or fragments thereof having substantially the same function and/or effect as those/that of the PH20 variant or fragment thereof according to the present invention, and having amino acid sequence homology of at least 80% or 85%, preferably at least 90%, more preferably at least 95%, and most preferably at least 99% to the PH20 variant or fragment thereof according to the present invention.

The PH20 variants or fragments thereof according to the present invention have increased expression levels and protein refolding rate, and thereby have higher thermal stability than mature wild-type PH20. Furthermore, the enzymatic activity of the PH20 variants was greater than or similar to that of mature wild-type PH20 despite the increase in thermal stability.

Meanwhile, although the mature wild-type PH20 variant having cleavage at the C-terminal is known to have decreased enzymatic activity, the PH20 variants according to the present invention exhibit similar or increased enzymatic activity and expression efficiency, and high protein aggregation temperatures ($T_{agg}$) due to the more rapid protein refolding and thermal stability thereof, although one or more amino acid residues at the C-terminus are cleaved and deleted, and/or 1 to 7, preferably, 1 to 5 amino acid residues at the N-terminus are cleaved and deleted.

Accordingly, the PH20 variant or fragment thereof according to the present invention is characterized in that it includes one or more amino acid mutations, preferably one or more amino acid residue substitutions, deletions and/or insertions in the variant having the amino acid sequence of SEQ ID NO: 3 or the like, and one or more amino acid residues of N-terminus and/or C-terminus are additionally deleted, but is not limited thereto.

In one embodiment, the PH20 variant or fragment thereof according to the present invention may be one in which cleavage occurs before an amino acid residue selected from the group consisting of M1 to P42 from the N-terminus, preferably before an amino acid residue L36, N37, F38, R39, A40, P41, or P42 at the N-terminus, in the amino acid sequence of SEQ ID NO: 3, so that one or more amino acid residues from the N-terminus are deleted, and/or cleavage occurs after an amino acid residue selected from the group consisting of V455 to L509, preferably after an amino acid residue selected from the group consisting of V455 to S490, most preferably after an amino acid residue V455, D456, C458, D461, C464, I465, D466, A467, F468, K470, P471, P472, M473, E474, T475, E476, P478, I480, Y482, A484, P486, T488, or S490 at the C-terminus, so that one or more amino acid residues at the C-terminus are deleted.

The expression "cleavage occurs before an amino acid residue selected from the group consisting of M1 to P42 at the N-terminus" means that a portion of amino acid residues immediately before the selected amino acid residue from among M1 to P42 at the N-terminus is cleaved and deleted. The expression "cleavage occurs before M1" means that no cleavage occurs at the N-terminus.

For example, the expression "cleavage occurs before an amino acid residue L36, N37, F38, R39, A40, P41, or P42" means that all amino acid residues from M1 to T35 immediately before L36, all amino acid residues from M1 to L36 immediately before N37, all amino acid residues from M1 to N37 immediately before F38, all amino acid residues from M1 to F38 immediately before R39, all amino acid residues from M1 to R39 immediately before A40, all amino acid residues from M1 to A40 immediately before P41, or all amino acid residues from M1 to P41 immediately before P42 in the amino acid sequence of SEQ ID NO: 3 according to the present invention are cleaved and removed.

In addition, the expression "cleavage occurs after an amino acid residue selected from the group consisting of V455 to L509 at the C-terminus" means that a portion of amino acid residues immediately before the selected amino acid residue from among M1 to P42 at the N-terminus is cleaved and deleted.

For example, the expression "cleavage occurs after an amino acid residue V455, D456, C458, D461, C464, I465, D466, A467, F468, K470, P471, P472, M473, E474, T475, E476, P478, I480, Y482, A484, P486, T488 or S490 at the C-terminus" means that an amino acid residue after the amino acid residue V455, D456, C458, D461, C464, I465, D466, A467, F468, K470, P471, P472, M473, E474, T475, E476, P478, I480, Y482, A484, P486, T488 or S490 in the amino acid sequence of SEQ ID NO: 3 according to the present invention is cleaved and removed.

Preferably, the novel PH20 variant or fragment thereof according to the present invention is characterized in that it includes an amino acid residue substitution, deletion or insertion at one or more positions in the variant having the amino acid sequence of SEQ ID NO: 3, a truncation before F38 at the N-terminus, and a truncation after F468 at the C-terminus.

More preferably, the novel PH20 variant or fragment thereof according to the present invention may include an amino acid sequence selected from the group consisting of amino acid sequences of SEQ ID NOS: 163 to 316, but is not limited thereto.

The sequences of the substituted or cleaved amino acids in the PH20 variant constructed in the specific embodiment according to the present invention are as shown in Table 6.

In addition, in the present invention, an attempt was made to increase the expression of a recombinant PH20 protein using other signal peptide of proteins highly expressed in animal cells, instead of using the original signal peptide of PH20.

Therefore, in another embodiment, the novel PH20 variant according to the present invention may be one in which the N-terminus further includes a human growth hormone signal peptide having an amino acid sequence MATGSRTSLLLAFGLLCLPWLQEGSA of SEQ ID NO: 4, a human serum albumin signal peptide having an amino acid sequence MKWVTFISLLFLFSSAYS of SEQ ID NO: 5, or a human Hyal1 signal peptide having an amino acid sequence MAAHLLPICALFLTLLDMAQG of SEQ ID NO: 6 as shown in Table 3 below, instead of the signal peptide of wild-type PH20, which consists of M1 to T35, but is not limited thereto.

The expression "instead of the signal peptide of wild-type PH20, which consists of M1 to T35" means the case in which the signal peptide in the amino acid sequence of SEQ ID NO: 3 is partially or completely deleted, and thus does not perform the function thereof. In addition, the expression is meant to include the case in which a portion of the N-terminus is further deleted, for example, the case in which cleavage occurs before the N37, F38, R39, A40, P41 or P42 residue occurs so that an additional deletion of the N-terminus together with the deletion of the signal peptide of wild-type PH20 occurs.

TABLE 3

| Signal peptide sequence according to present invention | | |
| --- | --- | --- |
| | Amino acid sequence | SEQ ID NO. |
| Human Growth hormone | MATGSRTSLLLAFGLLCLPWLQEGSA | 4 |
| Human serum albumin | MKWVTFISLLFLFSSAYS | 5 |
| Human Hyal1 | MAAHLLPICALFLTLLDMAQG | 6 |

In another aspect, the present invention is directed to a composition for treating cancer containing the novel PH20 variant or fragment thereof according to the present invention and a method for treating cancer using the same.

The cancers or carcinomas that can be treated by the novel PH20 variant or fragment thereof according to the present invention are not particularly limited, but include both solid cancers and blood cancers. The cancer may be selected from the group consisting of skin cancer such as melanoma, liver cancer, hepatocellular carcinoma, gastric cancer, breast cancer, lung cancer, ovarian cancer, bronchial cancer, nasopharyngeal cancer, laryngeal cancer, pancreatic cancer, bladder cancer, colorectal cancer, colon cancer, uterine cervical cancer, brain cancer, prostate cancer, bone cancer, thyroid cancer, parathyroid cancer, renal cancer, esophageal cancer, biliary tract cancer, testis cancer, rectal cancer, head and neck cancer, ureteral cancer, osteosarcoma, neurocytoma, fibrosarcoma, rhabdomyosarcoma, astrocytoma, neuroblastoma and neuroglioma, but is not limited thereto. Preferably, cancers that can be treated by the composition according to the present invention may be selected from the group consisting of colorectal cancer, breast cancer, lung cancer and renal cancer, but are not limited thereto.

The composition of the present invention may be a pharmaceutical composition. The pharmaceutical composition may further include a pharmaceutically acceptable composition. The composition may contain one or more selected from the group consisting of lactose, dextrose, sucrose, sorbitol, mannitol, starch, gum acacia, calcium phosphate, alginate, gelatin, calcium silicate, microcrystalline cellulose, polyvinylpyrrolidone, cellulose, water, syrups, methyl cellulose, methylhydroxybenzoate, propylhydroxybenzoate, talc, magnesium stearate, and mineral oil, which are typically used in the preparation of drugs, but is not limited thereto. In addition, the pharmaceutical composition may further contain one or more selected from the group consisting of diluents, excipients, lubricants, wetting agents, sweeteners, aromatics, emulsifiers, suspensions and preservatives, which are typically used in the preparation of drugs.

The pharmaceutical composition may be administered orally or parenterally. The parenteral administration is carried out by intravenous injection, subcutaneous injection, intramuscular injection, intraperitoneal injection, endothelial administration, topical administration, intranasal administration, intrapulmonary administration, rectal administration, and the like. For oral administration, the active ingredient in the oral composition needs to be formulated into a coated dosage form or into a dosage form that can protect the active ingredient from disintegrating in the stomach, considering that peptides and proteins are digested in the stomach. Alternatively, the present composition may be administered via any device by which the active ingredient can move to the target cell of interest.

The pharmaceutical composition may be formulated in the form of solutions, suspensions, syrups or emulsions in oils or aqueous media, or in the form of extracts, grains, powders, granules, tablets or capsules, and may additionally include dispersing or stabilizing agents for the purpose of formulation.

In particular, the composition for treating cancer according to the present invention may be used in combined therapy with other anticancer drugs.

An anticancer drug that can be used in combined therapy with the novel PH20 variant or fragment thereof according to the present invention is preferably a chemical anticancer drug, an antibody-based anticancer drug, a biological anticancer drug, an RNAi, or a cell therapeutic agent, but is not limited thereto.

Preferably, the anticancer drug that can be used in combined therapy with the novel PH20 variant or fragment thereof according to the present invention is preferably an immuno-oncologic agent, and more preferably an immune checkpoint inhibitor, but is not limited thereto.

In addition, the present invention is directed to a method for treating cancer using the novel PH20 variant or fragment in combination with other anticancer agents, particularly the anticancer agents described above.

In another aspect, the present invention is directed to a nucleic acid encoding the PH20 variant or fragment thereof.

The nucleic acids, as used herein, may be present in cells, in the cell lysate, or in the partially purified or substantially pure form. "Isolated" or "to be substantially pure", when referring to nucleic acids, refer to those that have been purified and thus separated from other cellular components or other contaminants, e.g., other cellular nucleic acids or proteins, by standard techniques, including alkaline/SDS treatment, CsCl banding, column chromatography, agarose gel electrophoresis, and others well known in the art. The nucleic acids of the present invention may be DNA or RNA.

In still another aspect, the present invention is directed to a recombinant expression vector including the nucleic acid. For expression of the PH20 variant or fragment thereof according to the present invention, a DNA encoding the PH20 variant or fragment thereof can be obtained by standard molecular biology techniques (e.g., PCR amplification or cDNA cloning using a hybridoma that expresses the PH20 variant), and the DNA can be inserted into an expression vector such that it is "operatively linked" to transcriptional and translational control sequences.

As used herein, the term "operatively linked" is intended to mean that a gene encoding the PH20 variant or fragment thereof is ligated into a vector such that transcriptional and translational control sequences serve intended functions thereof of regulating the transcription and translation of the gene encoding the PH20 variant or fragment thereof. The expression vector and expression control sequences are chosen to be compatible with the expression host cell that is used. The genes encoding the PH20 are inserted into the expression vector by standard methods (e.g., ligation of complementary restriction enzyme sites on a fragment of the gene encoding the PH20 variant or fragment thereof and a vector, or blunt-end ligation if no restriction enzyme sites are present).

In addition, the recombinant expression vectors carry regulatory sequences that control the expression of a gene encoding the PH20 variant or fragment thereof in the host cell. The term "regulatory sequence" is intended to include promoters, enhancers and other expression control elements (e.g., polyadenylation signals) that control the transcription or translation of the genes encoding the PH20 variant or fragment thereof. It will be appreciated by those skilled in the art that the design of the expression vector, including the selection of regulatory sequences, may depend on such factors as the choice of the host cell to be transformed, the desired level of expression of the protein, etc.

In yet another aspect, the present invention is directed to a host cell including the nucleic acid or the vector. The host cell according to the present invention is preferably selected from the group consisting of animal cells, plant cells, yeasts, *E. coli.*, and insect cells, but is not limited thereto.

Specifically, the host cell according to the present invention include prokaryotic cells such as *E. coli, Bacillus subtilis, Streptomyces* sp., *Pseudomonas* sp., *Proteus mirabilis* or *Staphylococcus* sp., fungi such as *Aspergillus* sp., yeasts such as *Pichia pastoris, Saccharomyces cerevisiae, Schizosaccharomyces* sp. and *Neurospora crassa*, and eukaryotic cells such as lower eukaryotic cells, and higher other eukaryotic cells such as insect cells.

In addition, the host cells that can be used in the present invention may be derived from plants or mammals. Preferably, examples of the host cells include, but are not limited to, monkey kidney cells (COS7), NSO cells, SP2/0, Chinese hamster ovary (CHO) cells, W138, baby hamster kidney (BHK) cells, MDCK, myeloma cells, HuT 78 cells and HEK293 cells. More preferably, CHO cells may be used.

The nucleic acid or the vector is transfected into a host cell. Transfection can be performed using various techniques that are generally used to introduce foreign nucleic acid (DNA or RNA) into prokaryotic or eukaryotic cells, for example, electrophoresis, calcium phosphate precipitation, DEAE-dextran transfection or lipofection. In order to express the PH20 variant or fragment thereof of the present invention, various combinations of recombinant expression vectors and host cells can be employed. The preferred expression vector for eukaryotic cells includes gene expression regulatory sequences derived from, but not limited to, SV40, bovine papillomavirus, adenovirus, adeno-associated virus, cytomegalovirus and retrovirus. Expression vectors that can be used for bacterial hosts include bacterial plasmids such as pET, pRSET, pBluescript, pGEX2T, pUC vectors, col E1, pCR1, pBR322, pMB9 and derivatives thereof, obtained from *E. coli*; a plasmid having broad host range, such as RP4; phage DNAs exemplified by various phage lambda derivatives, such as, λgt10, λgt11 and NM989; and other DNA phages, such as M13 and filamentous single-stranded DNA phage. An expression vector available for yeast cells may be a 2-μm plasmid and derivatives thereof. Expression vectors for insect cells include pVL941.

In another aspect, the present invention is directed to a method for producing a PH20 variant or fragment thereof, the method including culturing the host cell and expressing the PH20 variant or fragment thereof according to the present invention.

When a recombinant expression vector capable of expressing the PH20 variant or fragment thereof is introduced into mammalian host cells, the PH20 variant or fragment thereof can be produced by culturing the host cells for a period of time such that the PH20 variant or fragment thereof is expressed in the host cells, preferably a period of time such that the PH20 variant is secreted into the medium during culture of the host cells.

In an alternative embodiment, the expressed PH20 variant or fragment thereof can be isolated and purified from the host cells. Isolation or purification of the PH20 variant or fragment thereof can be performed by conventional isolation/purification methods (e.g., chromatography) that are used for proteins. The chromatography may include a combination of one or more selected from affinity chromatography, ion exchange chromatography, and hydrophobic chromatography, but is not limited thereto. In addition to the chromatography, a combination of filtration, ultrafiltration, salting out, dialysis, and the like may be used.

In order to confirm the industrial applicability of the enzyme, it is necessary to analyze the catalytic reaction rate of the enzyme. Types of enzymatic reactions include an enzyme reaction with an active site with fixed reactivity and an enzyme reaction with several active sites with various reactivity. It is known that the catalytic reaction rate of enzymes having an active site with fixed reactivity, such as hyaluronidase, follows the Michaelis-Menten rate formula.

The Michaelis-Menten's enzyme kinetics is premised on the assumption of an enzymatic reaction as a two-step reaction system including a reversible reaction step in which Complex [ES] of Enzyme (E)-Substrate (S) is formed and an irreversible reaction step in which the ES complex is dissociated to yield Product (P). In this case, $k_f$, $k_r$ and $k_{cat}$ are the rate constants of the reaction in each direction (Alan Fersht (1977) Enzyme structure and mechanism).

$$E + S \overset{k_f}{\underset{k_r}{\rightleftarrows}} ES \overset{kcat}{\longrightarrow} E + P$$

The enzymatic reaction assumes that the process of reacting the enzyme with the substrate to produce the ES complex rapidly reaches equilibrium, or may be considered to be a pseudo-steady state assuming that $d[ES]/dt \approx 0$ is satisfied by sufficiently lowering the concentration of the enzyme by performing a reaction that maintains a sufficiently high substrate concentration. Since the rate equations assuming fast equilibrium or pseudo-steady state are derived in the same manner, a pseudo-steady state in which the substrate concentration is initially higher than the enzyme concentration is assumed in most experiments.

When conditions such as "the amount of enzyme is constant before and after the reaction" and "when a chemical reaction reaches chemical equilibrium, the reaction rate at which the product is obtained is equal to the rate at which the product is decomposed again" are used under such an assumption, the reaction rate of the final product may be expressed by the following Michaelis-Menten rate formula. In this case, $K_M = (k_r + k_{cat})/k_f$, and $V_{max} = k_{cat}[E]_0$.

$$v = \frac{d[P]}{dt} = \frac{V_{max}[S]}{K_M + [S]}$$

The Lineweaver-Burk equation is used to experimentally analyze the enzyme reaction rate using the Michaelis-Menten rate formula. This equation shows the relationship between the reciprocal 1/V of the experimentally measured reaction rate with the reciprocal 1/[S] of the given substrate concentration in the experiment. Statistical verification that this equation is a linear equation demonstrates that the enzyme reaction is a reaction following Michaelis-Menten's rate formula, and $K_M$ and $V_{max}$ can be calculated using this equation.

Enzymes that catalyze a chemical reaction have a transition state after binding to a substrate at an active site, and the activation energy for reaching the transition state having high energy is lowered through multiple bonds with the substrate. The equilibrium constant for reaching this transition state is proportional to $k_{cat}/K_M$. Here, $1/K_M$ is an index that combines the degree to which an enzyme-substrate complex is produced by bonding the enzyme to the substrate with the degree to which the enzyme-substrate complex is maintained without being decomposed, and $k_{cat}$ is the equilibrium constant at which a product is obtained from the enzyme-substrate complex. Therefore, $k_{cat}/K_M$ can be said to be an indicator of how much product can be obtained from the substrate and the enzyme, that is, the catalytic efficiency of the enzyme.

The industrial availability of hyaluronidase is proportional to the catalytic efficiency thereof. In particular, when the enzyme is injected subcutaneously along with a polymeric pharmacologically active substance such as a monoclonal antibody, the catalytic efficiency of hyaluronidase plays an important role. In the case where the variant according to the present invention has higher $k_{cat}/K_M$ than the wild-type PH20, when the hyaluronidase combined with the polymeric pharmacologically active substance is administered subcutaneously, hyaluronic acid present therein is rapidly decomposed and thus a superior effect of rapidly dispersing the pharmacologically active substance can be obtained. In addition, when the variant according to the present invention has a larger $k_{cat}$ than the wild-type PH20, the maximum reaction rate $V_{max}$ increases at the same enzyme concentration, thereby providing excellent effects of decomposing a greater amount of hyaluronic acid during the same period of time and dispersing the pharmacologically active substance in a wider region.

Therefore, in order to confirm the enzymatic properties of the PH20 variant according to the present invention, the enzyme reaction rate of each variant was analyzed, and $V_{max}$ (maximum enzyme reaction rate), $K_M$ (substrate concentration under 50% $V_{max}$ condition), $k_{cat}$ (substrate conversion rate), and $k_{cat}/K_M$ (enzyme catalyst efficiency) thereof were compared in Example 4. The results described above demonstrate that the PH20 variant according to the present invention is superior to wild-type PH20.

EXAMPLE

Hereinafter, the present invention will be described in more detail with reference to examples. However, it will be obvious to those skilled in the art that these examples are provided only for illustration of the present invention and should not be construed as limiting the scope of the present invention.

Example 1. Construction of PH20 Variants

For construction of PH20 variants, cDNA (clone ID: hMU002604) of wild-type PH20 was purchased from the Korean Human Gene Bank. Wild-type PH20 encodes amino acids from L36 to S490. The PH20 gene was amplified by polymerase chain reaction (hereinafter referred to as PCR) and inserted into the XhoI and NotI restriction enzyme sites of a pcDNA3.4-TOPO vector. For expression in EXPICHO™ cells, the signal peptide of human growth hormone, human serum hormone or human Hyal1 was used as a signal peptide instead of the original signal peptide of PH20. For protein purification using a HisTrap column, the DNA sequence of a His-tag was located at the 3'-end of the PH20 cDNA. The amino acid substitution of PH20 variants was performed using PCR, and the amino acid substitution was confirmed through DNA sequencing.

The list of primers used in cloning of the PH20 variants are summarized in Table 4 below, and the specific sequences of the primers are summarized in Table 5 below.

TABLE 4

List of primers used in cloning of PH 20 variants according to present invention

| Clone | Primer 1 | Primer 2 | Primer 3 |
|---|---|---|---|
| cB4205 | ALB-SP-Xho | B4-hy2 | SPAM1-6H-not |
| cB4206 | ALB-SP-Xho | B4-hy3 | SPAM1-6H-not |
| cB4207 | ALB-SP-Xho | B4-hy4 | SPAM1-6H-not |
| cB4213-m63 | opB4-Xho-hSA | op-F468-6H-not | — |
| cB4213-m64 | opB4-Xho-hSA | op-Q347-m64 | op-F468-6H-not |
| cB4213-m65 | op-Xho-hSA-L | op-Q348-m65 | op-F468-R |
| cB4213-m66 | op-Xho-hSA-L | op-Q350-m66 | op-F468-R |
| cB4213-m67 | opB4-Xho-hSA | op-Q355-m67 | op-F468-6H-not |
| cB4213-m69 | op-Xho-hSA-L | op-V358-m69 | op-F468-6H-not |
| cB4213-m70 | op-Xho-hSA-L | op-A362-m70 | op-F468-6H-not |
| cB4213-m71 | opB4-Xho-hSA | op-V343-m71 | op-F468-6H-not |
| cB4213-m72 | opB4-Xho-hSA | op-F344-m72 | op-F468-6H-not |
| cB4213-m73 | op-Xho-hSA-L | op-K359-mega-NL73 | op-F468-6H-not |
| cB4213-m74 | op-Xho-hSA-L | op-Y360-m74 | op-F468-6H-not |
| cB4213-m75 | opB4-Xho-hSA | op-M361-m75 | op-F468-6H-not |
| cB4213-m76 | opB4-Xho-hSA | op-E352-m76 | op-F468-6H-not |
| cB4213-m77 | opB4-Xho-hSA | op-M363-m77 | op-F468-6H-not |
| cB4213-m78 | opB4-Xho-hSA | op-N84-m78 | op-F468-6H-not |
| cB4213-m79 | opB4-Xho-hSA | op-K166-m79 | op-F468-6H-not |
| cB4213-m82 | op-Xho-hSA-L | op-354E-m82 | op-F468-6H-not |
| cB4213-m83 | op-Xho-hSA-L | op-354Q-m83 | op-F468-6H-not |
| cB4213-m84 | op-Xho-hSA-L | op-354S-m84 | op-F468-6H-not |
| cB4213-m85 | op-Xho-hSA-L | op-354V-m85 | op-F468-6H-not |
| cB4213-m86 | op-Xho-hSA-L | op-354A-m86 | op-F468-6H-not |
| cB4213-m88 | op-Xho-hSA-L | op-354N-m88 | op-F468-6H-not |
| cB4213-m89 | op-Xho-hSA-L | op-354T-m89 | op-F468-6H-not |
| cB4213-m90 | op-Xho-hSA-L | op-356M-m90 | op-F468-6H-not |
| cB4213-m91 | op-Xho-hSA-L | op-356F-m91 | op-F468-6H-not |
| cB4213-m92 | op-Xho-hSA-L | op-356I-m92 | op-F468-6H-not |
| cB4213-m93 | op-Xho-hSA-L | op-356L-m93 | op-F468-6H-not |
| cB4213-m94 | op-Xho-hSA-L | op-356Q-m94 | op-F468-6H-not |
| cB4213-m95 | op-Xho-hSA-L | op-356V-m95 | op-F468-6H-not |
| cB4213-m96 | op-Xho-hSA-L | op-343V_364M-m96 | op-F468-6H-not |
| cB4213-m97 | op-Xho-hSA-L | op-340Q-m97 | op-F468-6H-not |
| cB4213-m98 | op-Xho-hSA-L | op-341H-m98 | op-F468-6H-not |
| cB4213-m99 | op-Xho-hSA-L | op-342I-m99 | op-F468-6H-not |
| cB4213-m100 | op-Xho-hSA-L | op-343Y-m100 | op-F468-6H-not |
| cB4213-m101 | op-Xho-hSA-L | op-345E-m101 | op-F468-6H-not |
| cB4213-m102 | op-Xho-hSA-L | op-346F-m102 | op-F468-6H-not |
| cB4213-m103 | op-Xho-hSA-L | op-347E-m103 | op-F468-6H-not |
| cB4213-m104 | op-Xho-hSA-L | op-349L-m104 | op-F468-6H-not |
| cB4213-m105 | op-Xho-hSA-L | op-350I-m105 | op-F468-6H-not |
| cB4213-m106 | op-Xho-hSA-L | op-352G-m106 | op-F468-6H-not |
| cB4213-m107 | op-Xho-hSA-L | op-354R-m107 | op-F468-6H-not |
| cB4213-m110 | op-Xho-hSA-L | op-358R-m110 | op-F468-6H-not |
| cB4213-m111 | op-Xho-hSA-L | op-359V-m111 | op-F468-6H-not |
| cB4213-m112 | op-Xho-hSA-L | op-360R-m112 | op-F468-6H-not |
| cB4213-m114 | op-Xho-hSA-L | op-345K-m114 | op-F468-6H-not |
| cB4213-m115 | op-Xho-hSA-L | op-346L-m115 | op-F468-6H-not |
| cB4213-m116 | op-Xho-hSA-L | op-347V-m116 | op-F468-6H-not |
| cB4213-m117 | op-Xho-hSA-L | op-349W-m117 | op-F468-6H-not |
| cB4213-m118 | op-Xho-hSA-L | op-354W-m118 | op-F468-6H-not |
| cB4213-m121 | op-Xho-hSA-L | op-359Y-m121 | op-F468-6H-not |
| cB4213-m125 | op-Xho-hSA-L | op-347W-m125 | op-F468-6H-not |
| cB4213-m126 | op-Xho-hSA-L | op-357W-m126 | op-F468-6H-not |
| cB4213-m130 | op-Xho-hSA-L | op-342D-m130 | op-F468-6H-not |
| cB4213-m131 | op-Xho-hSA-L | op-343Q-m131 | op-F468-6H-not |
| cB4213-m132 | op-Xho-hSA-L | op-347H-m132 | op-F468-6H-not |
| cB4213-m133 | op-Xho-hSA-L | op-348F-m133 | op-F468-6H-not |

TABLE 4-continued

List of primers used in cloning of PH 20 variants according to present invention

| Clone | Primer 1 | Primer 2 | Primer 3 |
|---|---|---|---|
| cB4213-m134 | op-Xho-hSA-L | op-350D-m134 | op-F468-6H-not |
| cB4213-m135 | op-Xho-hSA-L | op-352Y-m135 | op-F468-6H-not |
| cB4213-m136 | op-Xho-hSA-L | op-353E-m136 | op-F468-6H-not |
| cB4213-m138 | op-Xho-hSA-L | op-358Y-m138 | op-F468-6H-not |
| cB4213-m139 | op-Xho-hSA-L | op-359Q-m139 | op-F468-6H-not |
| cB4213-m140 | op-Xho-hSA-L | op-360L-m140 | op-F468-6H-not |
| cB4213-m141 | op-Xho-hSA-L | op-361E-m141 | op-F468-6H-not |
| cB4213-m142 | op-Xho-hSA-L | op-363E-m142 | op-F468-6H-not |
| cB4213-m143 | op-Xho-hSA-L | op-342H-m143 | op-F468-6H-not |
| cB4213-m144 | op-Xho-hSA-L | op-348D-m144 | op-F468-6H-not |
| cB4213-m145 | op-Xho-hSA-L | op-361H-m145 | op-F468-6H-not |
| cB4213-m146 | opB4-Xho-hSA | Op-R39-m146-R | op-F468-6H-not |
| cB4213-m147 | opB4-Xho-hSA | Op-A40-m147-R | op-F468-6H-not |
| cB4213-m149 | opB4-Xho-hSA | op-D456-6H-not | — |
| cB4213-m150 | op-Xho-hSA-L | op-350Q360R-m150 | op-F468-6H-not |
| cB4213-m152 | opB4-Xho-hSA | Op-m152-D65A-R | op-F468-6H-not |
| cB4213-m153 | opB4-Xho-hSA | Op-m153-E66A-R | op-F468-6H-not |
| cB4213-m154 | opB4-Xho-hSA | Op-m154-P67A-R | op-F468-6H-not |
| cB4213-m155 | opB4-Xho-hSA | Op-m155-L68A-R | op-F468-6H-not |
| cB4213-m156 | op-Xho-hSA-L | op-311A-m156 | op-F468-6H-not |
| cB4213-m157 | op-Xho-hSA-L | op-312A-m157 | op-F468-6H-not |
| cB4213-m158 | op-Xho-hSA-L | op-313A-m158 | op-F468-6H-not |
| cB4213-m159 | op-Xho-hSA-L | op-314A-m159 | op-F468-6H-not |
| cB4213-m160 | op-Xho-hSA-L | N266A-m160 | op-F468-6H-not |
| cB4213-m161 | op-Xho-hSA-L | T267A-m161 | op-F468-6H-not |
| cB4213-m162 | op-Xho-hSA-L | Q268A-m162 | op-F468-6H-not |
| cB4213-m163 | op-Xho-hSA-L | Q269A-m163 | op-F468-6H-not |
| cB4213-m164 | op-Xho-hSA-L | P271A-m164 | op-F468-6H-not |
| cB4213-m165 | op-Xho-hSA-L | V272A-m165 | op-F468-6H-not |
| cB4213-m166 | opB4-Xho-hSA | Op-m166-I102A-R | op-F468-6H-not |
| cB4213-m167 | opB4-Xho-hSA | Op-m167-D103A-R | op-F468-6H-not |
| cB4213-m168 | opB4-Xho-hSA | Op-m168-S104A-R | op-F468-6H-not |
| cB4213-m169 | opB4-Xho-hSA | Op-m169-I105A-R | op-F468-6H-not |
| cB4213-m170 | op-Xho-hSA-L | op-m170-T132A-R | op-F468-6H-not |
| cB4213-m171 | op-Xho-hSA-L | op-m171-F133A-R | op-F468-6H-not |
| cB4213-m172 | op-Xho-hSA-L | op-m172-Y134A-R | op-F468-6H-not |
| cB4213-m173 | op-Xho-hSA-L | V241A-m173 | op-F468-6H-not |
| cB4213-m174 | op-Xho-hSA-L | E242A-m174 | op-F468-6H-not |
| cB4213-m175 | op-Xho-hSA-L | I243A-m175 | op-F468-6H-not |
| cB4213-m176 | op-Xho-hSA-L | K244A-m176 | op-F468-6H-not |
| cB4213-m177 | opB4-Xho-hSA | Op-m177-L179A-R | op-F468-6H-not |
| cB4213-m178 | opB4-Xho-hSA | Op-m178-S180A-R | op-F468-6H-not |
| cB4213-m179 | opB4-Xho-hSA | Op-m179-L181A-R | op-F468-6H-not |
| cB4213-m180 | opB4-Xho-hSA | Op-m180-T182A-R | op-F468-6H-not |
| cB4213-m181 | opB4-Xho-hSA | Op-m181-T185A-R | op-F468-6H-not |
| cB4213-m182 | opB4-Xho-hSA | Op-m182-E186A-R | op-F468-6H-not |
| cB4213-m183 | opB4-Xho-hSA | Op-m183-K187A-R | op-F468-6H-not |
| cB4213-m184 | op-Xho-hSA-L | op-K290A-m184 | op-F468-6H-not |
| cB4213-m185 | op-Xho-hSA-L | op-I291A-m185 | op-F468-6H-not |
| cB4213-m186 | op-Xho-hSA-L | op-P292A-m186 | op-F468-6H-not |
| cB4213-m190 | op-Xho-hSA-L | L441A-m190 | op-F468-6H-not |
| cB4213-m191 | op-Xho-hSA-L | S442A-m191 | op-F468-6H-not |
| cB4213-m192 | opB4-Xho-hSA | op-D451A-m192 | op-F468-6H-not |
| cB4213-m193 | opB4-Xho-hSA | op-T452A-m193 | op-F468-6H-not |
| cB4213-m194 | op-Xho-hSA-L | op-D453A-m194 | op-F468-6H-not |
| cB4213-m195 | op-Xho-hSA-L | op-D461A-6H-not | op-F468-6H-not |
| cB4213-m196 | op-Xho-hSA-L | op-G462A-6H-not | op-F468-6H-not |
| cB4213-m197 | op-Xho-hSA-L | op-V463A-6H-not | op-F468-6H-not |
| cB4213-m198 | op-Xho-hSA-L | op-N82A-m198-R | op-F468-6H-not |
| cB4213-m199 | op-Xho-hSA-L | op-N166A-m199-R | op-F468-6H-not |
| cB4213-m203 | op-Xho-hSA-L | Op-S104N-m203-R | op-F468-6H-not |
| cB4213-m204 | op-Xho-hSA-L | Op-I105Q-m204-R | op-F468-6H-not |
| cB4213-m205 | op-Xho-hSA-L | op-Q268D-m205-F | op-F468-6H-not |
| cB4213-m208 | op-Xho-hSA-L | op-Q268I-m208-F | op-F468-6H-not |
| cB4213-m210 | op-Xho-hSA-L | op-291G-m210-F | op-F468-6H-not |
| cB4213-m211 | op-Xho-hSA-L | op-292D-m211-F | op-F468-6H-not |
| cB4213-m212 | op-Xho-hSA-L | op-T452D-m212 | op-F468-6H-not |
| cB4213-m213 | op-Xho-hSA-L | op-T452H-m213 | op-F468-6H-not |
| cB4213-m214 | op-Xho-hSA-L | op-T452K-m214 | op-F468-6H-not |
| cB4213-m216 | op-Xho-hSA-L | Op-T452G-m216 | op-F468-6H-not |
| cB4213-m217 | op-Xho-hSA-L | Op-T452P-m217 | op-F468-6H-not |
| cB4213-m218 | op-Xho-hSA-L | op-T452M-m218 | op-F468-6H-not |
| cB4213-m219 | op-Xho-hSA-L | op-T452F-m219 | op-F468-6H-not |

TABLE 4-continued

List of primers used in cloning of PH 20
variants according to present invention

| Clone | Primer | | |
|---|---|---|---|
| | 1 | 2 | 3 |
| cB4213-m220 | op-Xho-hSA-L | op-D461R-6H-not-m220 | op-F468-6H-not |
| cB4213-m231 | op-Xho-hSA-L | op-V463Y-6H-not-m231 | — |
| cB4213-m232 | op-Xho-hSA-L | op-S180T-R-m232 | op-F468-6H-not |
| cB4213-m233 | op-Xho-hSA-L | op-D451S-F-m233 | op-F468-6H-not |
| cB4213-m234 | op-Xho-hSA-L | op-L313P-m234-F | op-F468-6H-not |
| cB4213-m235 | op-Xho-hSA-L | op-L313M-m235-F | op-F468-6H-not |
| cB4213-m243 | op-Xho-hSA-L | op-L179S-m243-R | op-F468-6H-not |
| cB4213-m245 | op-Xho-hSA-L | op-L179I-m245-R | op-F468-6H-not |
| cB4213-m246 | op-Xho-hSA-L | op-L179F-m246-R | op-F468-6H-not |
| cB4213-m254 | op-Xho-hSA-L | FQQ-Mega-m254 | op-F468-6H-not |
| cB4213-m261 | op-Xho-hSA-L | op-Q268N-m259-m | op-F468-6H-not |
| cB4213-m262 | op-Xho-hSA-L | B4-124-R | op-F468-6H-not |

TABLE 4-continued

List of primers used in cloning of PH 20
variants according to present invention

| Clone | Primer | | |
|---|---|---|---|
| | 1 | 2 | 3 |
| cB4213-m263 | op-Xho-hSA-L | B4-124-R | op-F468-6H-not |
| cB4213-m266 | op-Xho-hSA-L | op-L181M, E186D-m266 | op-F468-6H-not |
| cB4213-m268 | opB4-Xho-hSA | op-Q268A-m268-m | op-F468-6H-not |
| cB4213-m271 | opB4-Xho-hSA | op-344I, 348M-m271 | op-F468-6H-not |
| cB4213-m275 | op-Xho-hSA-L | op-DLSS-m275 | op-F468-6H-not |
| cB4213-m276 | op-Xho-hSA-L | op-DLS-m276 | op-F468-6H-not |
| cB4213-m279 | opB4-Xho-hSA | Op-K348M-m279 | op-F468-6H-not |
| cB4213-m280 | opB4-Xho-hSA | Op-N344I K348M-m280 | op-F468-6H-not |
| cB4213-m287 | op-Xho-hSA-L | Q268A-m162 | op-F468-6H-not |
| cB4213-m288 | opB4-Xho-hSA | Q268A-m162 | op-F468-6H-not |

TABLE 5

Primer sequences used for cloning of PH20
variants

| Primer | SEQ ID NO | Nucleotide sequence (5'->3') |
|---|---|---|
| B4-hy2 | 7 | ATA TGG GGA ACC CTC AGT ATA ACT ACA AGC ACT GAG ACC TGC CAA TAT CTG AAG GAT TAC CTG ACC AGA CTG CTG AAT CCT TAC ATA ATC AAC |
| B4-hy3 | 8 | ATA TGG GGA ACC CTC AGT ATA TCC AGC AGT GAG GAA GAA TGC TGG CAT TTG CAC GAT TAC CTG GTA GAC ACA CTG AAT CCT TAC ATA ATC AAC |
| B4-hy4 | 9 | ATA TGG GGA ACC CTC AGT ATA ACC GCA TCT AAG GCA AAC TGC ACA AAA GTA AAA CAA TTC GTC TCC AGT GAT CTG AAT CCT TAC ATA ATC AAC |
| ALB-SP-Xho | 10 | GAA TAT CTC GAG GCC ACC ATG AAG TGG GTT ACA |
| SPAM1-6H-not | 11 | CTA ATT GCG GCC GCT CAT TAG TGG TGA TGG TGA TGA TGG AAG AAA CCA ATT CTG C |
| op-F468-R | 12 | AAT TAG GCG GCC GCC TAT TAA AAG GCG TCG ATG CAC ACG CCA TC |
| op-F468-6H-not | 13 | CTC TAA TTG CGG CCG CTC ATT AGT GGT GAT GGT GAT GAT GAA AGG CGT CGA TGC ACA CGC CAT C |
| op-Xho-hSA-L | 14 | AAT TAG AGC TCG AGG CCA CCA TGA AAT GGG TGA CCT TTA TCT CC |
| opB4-Xho-hSA | 15 | CAG ATT CTC GAG GCC ACC ATG AAA TGG G |
| op-Q347-m64 | 16 | ATC TGG GGC TCC TGG GAG AAC ACC AGG CAG AAG GAG AGC TGC CAG GCC ATC |
| op-Q348-m65 | 17 | ATC TGG GGC TCC TGG GAG AAC ACC AGG ACC CAG GAG AGC TGC CAG GCC ATC AAG |
| op-Q350-m66 | 18 | AGA ACA CCA GGA CCA AGG AGC AAT GCC AGG CCA TCA AGG AGT AC |
| op-Q355-m67 | 19 | AGG AGA GCT GCC AGG CCA TCC AGG AGT ACA TGG ACA CAA CCC TG |
| op-V358-m69 | 20 | AGC TGC CAG GCC ATC AAG GAG TAC GTG GAC ACA ACC CTG AAC CCT TAT ATC |
| op-A362-m70 | 21 | AGG AGT ACA TGG ACA CAA CCG CGA ACC CTT ATA TCA TCA ATG |

TABLE 5-continued

| | | Primer sequences used for cloning of PH20 variants |
|---|---|---|

| Primer | SEQ ID NO | Nucleotide sequence (5'->3') |
|---|---|---|
| op-V343-m71 | 22 | ATC GTG ATC TGG GGC TCC TGG GTG AAC ACC AGG ACC AAG GAG AG |
| op-F344-m72 | 23 | ATC TGG GGC TCC TGG GAG TTC ACC AGG ACC AAG GAG AGC TG |
| op-K359-mega-NL73 | 24 | AGC TGC CAG GCC ATC AAG GAG TAC ATG AAA ACA ACC CTG AAC CCT TAT ATC |
| op-Y360-m74 | 25 | ATC AAG GAG TAC ATG GAC TAC ACC CTG AAC CCT TAT ATC ATC |
| op-M361-m75 | 26 | ATC AAG GAG TAC ATG GAC ACA ATG CTG AAC CCT TAT ATC ATC |
| op-E352-m76 | 27 | ACC AGG ACC AAG GAG AGC TGC GAG GCC ATC AAG GAG TAC ATG G |
| op-M363-m77 | 28 | AGT ACA TGG ACA CAA CCC TGA TGC CTT ATA TCA TCA ATG TGA C |
| op-N84-m78 | 29 | TAG AAG ATT GTC ACG CCC TGG CCG TTG GCA TTG ATC CGA GGA GAG C |
| op-K166-m79 | 30 | TGC ACC AGC TCG ATG GAC CGT TTC TTA TAC ACG TCC TTA GGC TTC |
| op-354E-m82 | 31 | ACC AAG GAG AGC TGC CAG GCC GAA AAG GAG TAC ATG GAC ACA ACC |
| op-354Q-m83 | 32 | ACC AAG GAG AGC TGC CAG GCC CAA AAG GAG TAC ATG GAC ACA ACC |
| op-354S-m84 | 33 | ACC AAG GAG AGC TGC CAG GCC TCT AAG GAG TAC ATG GAC ACA ACC |
| op-354V-m85 | 34 | ACC AAG GAG AGC TGC CAG GCC GTC AAG GAG TAC ATG GAC ACA ACC |
| op-354A-m86 | 35 | ACC AAG GAG AGC TGC CAG GCC GCG AAG GAG TAC ATG GAC ACA ACC |
| op-354N-m88 | 36 | ACC AAG GAG AGC TGC CAG GCC AAC AAG GAG TAC ATG GAC ACA ACC |
| op-354T-m89 | 37 | ACC AAG GAG AGC TGC CAG GCC ACC AAG GAG TAC ATG GAC ACA ACC |
| op-356M-m90 | 38 | AAG GAG AGC TGC CAG GCC ATC AAG ATG TAC ATG GAC ACA ACC CTG AAC |
| op-356F-m91 | 39 | AAG GAG AGC TGC CAG GCC ATC AAG TTC TAC ATG GAC ACA ACC CTG AAC |
| op-356I-m92 | 40 | AAG GAG AGC TGC CAG GCC ATC AAG ATA TAC ATG GAC ACA ACC CTG AAC |
| op-356L-m93 | 41 | AAG GAG AGC TGC CAG GCC ATC AAG TTG TAC ATG GAC ACA ACC CTG AAC |
| op-356Q-m94 | 42 | AAG GAG AGC TGC CAG GCC ATC AAG CAG TAC ATG GAC ACA ACC CTG AAC |
| op-356V-m95 | 43 | AAG GAG AGC TGC CAG GCC ATC AAG GTA TAC ATG GAC ACA ACC CTG AAC |
| op-343V_364M-m96 | 44 | ATC GTG ATC TGG GGC TCC TGG GTG AAC ACC AGG ACC AAG GAG AGC TGC CAG GCC ATC AAG GAG TAC ATG GAC ACA ATG CTG AAC CCT TAT ATC ATC |
| op-340Q-m97 | 45 | AGC TAG CGG CAT CGT GAT CTG GCA ATC CTG GGA GAA CAC CAG GAC C |

TABLE 5-continued

Primer sequences used for cloning of PH20
variants

| Primer | SEQ ID NO | Nucleotide sequence (5'->3') |
|---|---|---|
| op-341H-m98 | 46 | AGC GGC ATC GTG ATC TGG GGC CAC TGG GAG AAC ACC AGG ACC AAG |
| op-342I-m99 | 47 | AGC GGC ATC GTG ATC TGG GGC TCC ATT GAG AAC ACC AGG ACC AAG GAG |
| op-343Y-m100 | 48 | ATC GTG ATC TGG GGC TCC TGG TAT AAC ACC AGG ACC AAG GAG AG |
| op-345E-m101 | 49 | ATC GTG ATC TGG GGC TCC TGG GAG AAC GAA AGG ACC AAG GAG AGC TGC C |
| op-346F-m102 | 50 | ATC TGG GGC TCC TGG GAG AAC ACC TTC ACC AAG GAG AGC TGC CAG GC |
| op-347E-m103 | 51 | ATC TGG GGC TCC TGG GAG AAC ACC AGG GAA AAG GAG AGC TGC CAG GCC ATC |
| op-349L-m104 | 52 | ATC TGG GGC TCC TGG GAG AAC ACC AGG ACC AAG TTG AGC TGC CAG GCC ATC AAG G |
| op-350I-m105 | 53 | AGA ACA CCA GGA CCA AGG AGA TCT GCC AGG CCA TCA AGG AG |
| op-352G-m106 | 54 | ACC AGG ACC AAG GAG AGC TGC GGG GCC ATC AAG GAG TAC ATG GAC |
| op-354R-m107 | 55 | ACC AAG GAG AGC TGC CAG GCC AGA AAG GAG TAC ATG GAC ACA AC |
| op-358R-m110 | 56 | AGC TGC CAG GCC ATC AAG GAG TAC CGG GAC ACA ACC CTG AAC CCT TAT ATC |
| op-359V-m111 | 57 | AGG CCA TCA AGG AGT ACA TGG TCA CAA CCC TGA ACC CTT ATA TC |
| op-360R-m112 | 58 | AGG CCA TCA AGG AGT ACA TGG ACA GAA CCC TGA ACC CTT ATA TCA TC |
| op-345K-m114 | 59 | ATC TGG GGC TCC TGG GAG AAC AAG AGG ACC AAG GAG AGC TGC CAG |
| op-346L-m115 | 60 | ATC TGG GGC TCC TGG GAG AAC ACC CTG ACC AAG GAG AGC TGC CAG GC |
| op-347V-m116 | 61 | ATC TGG GGC TCC TGG GAG AAC ACC AGG GTC AAG GAG AGC TGC CAG GCC ATC |
| op-349W-m117 | 62 | ATC TGG GGC TCC TGG GAG AAC ACC AGG ACC AAG TGG AGC TGC CAG GCC ATC AAG GAG |
| op-354W-m118 | 63 | ACC AAG GAG AGC TGC CAG GCC TGG AAG GAG TAC ATG GAC ACA AC |
| op-359Y-m121 | 64 | AGG CCA TCA AGG AGT ACA TGT ACA CAA CCC TGA ACC CTT ATA TC |
| op-347W-m125 | 65 | ATC TGG GGC TCC TGG GAG AAC ACC AGG TGG AAG GAG AGC TGC CAG GCC ATC |
| op-357W-m126 | 66 | AGC TGC CAG GCC ATC AAG GAG TGG ATG GAC ACA ACC CTG AAC CC |
| op-342D-m130 | 67 | AGC GGC ATC GTG ATC TGG GGC TCC GAC GAG AAC ACC AGG ACC AAG GAG |
| op-343Q-m131 | 68 | ATC GTG ATC TGG GGC TCC TGG CAG AAC ACC AGG ACC AAG GAG AGC |
| op-347H-m132 | 69 | ATC TGG GGC TCC TGG GAG AAC ACC AGG CAC AAG GAG AGC TGC CAG GCC ATC |

TABLE 5-continued

| Primer sequences used for cloning of PH20 variants |
| --- |

| Primer | SEQ ID NO | Nucleotide sequence (5'->3') |
| --- | --- | --- |
| op-348F-m133 | 70 | ATC TGG GGC TCC TGG GAG AAC ACC AGG ACC TTC GAG AGC TGC CAG GCC ATC AAG |
| op-350D-m134 | 71 | AGA ACA CCA GGA CCA AGG AGG ACT GCC AGG CCA TCA AGG AGT AC |
| op-352Y-m135 | 72 | ACC AGG ACC AAG GAG AGC TGC TAC GCC ATC AAG GAG TAC ATG GAC AC |
| op-353E-m136 | 73 | AGG ACC AAG GAG AGC TGC CAG GAA ATC AAG GAG TAC ATG GAC AC |
| op-358Y-m138 | 74 | AGC TGC CAG GCC ATC AAG GAG TAC TAC GAC ACA ACC CTG AAC CCT TAT ATC |
| op-359Q-m139 | 75 | AGG CCA TCA AGG AGT ACA TGC AGA CAA CCC TGA ACC CTT ATA TC |
| op-360L-m140 | 76 | AGG CCA TCA AGG AGT ACA TGG ACC TAA CCC TGA ACC CTT ATA TCA TC |
| op-361E-m141 | 77 | ATC AAG GAG TAC ATG GAC ACA GAG CTG AAC CCT TAT ATC ATC AAT G |
| op-363E-m142 | 78 | AGT ACA TGG ACA CAA CCC TGG AGC CTT ATA TCA TCA ATG TGA C |
| op-342H-m143 | 79 | AGC GGC ATC GTG ATC TGG GGC TCC CAT GAG AAC ACC AGG ACC AAG GAG |
| op-348D-m144 | 80 | ATC TGG GGC TCC TGG GAG AAC ACC AGG ACC GAC GAG AGC TGC CAG GCC ATC AAG |
| op-361H-m145 | 81 | ATC AAG GAG TAC ATG GAC ACA CAC CTG AAC CCT TAT ATC ATC AAT G |
| Op-R39-m146-R | 82 | TTT GGA ATC ACA GGA GGA GCC CGA GAG TAT GCG GAG CTA AAC AG |
| Op-A40-m147-R | 83 | TTT GGA ATC ACA GGA GGA GCA GAG TAT GCG GAG CTA AAC AG |
| op-D456-6H-not | 84 | CTC TAA TTG CGG CCG CCT ATT AGT GGT GAT GGT GAT GAT GGT CCA CGG CAT CTG TGT CCT TC |
| op-350Q360R-m150 | 85 | AGA ACA CCA GGA CCA AGG AGC AGT GCC AGG CCA TCA AGG AGT ACA TGG ACC GAA CCC TGA ACC CTT ATA TCA TC |
| Op-m152-D65A-R | 86 | TAA AAG AGA ACA GGC TCA TAT CCA GGG GCT CGG CAA ACT TGC CCA GGC AGA ACT C |
| Op-m153-E66A-R | 87 | TAA AAG AGA ACA GGC TCA TAT CCA GGG GCG CGT CAA ACT TGC CCA GGC AGA AC |
| Op-m154-P67A-R | 88 | TAA AAG AGA ACA GGC TCA TAT CCA GGG CCT CGT CAA ACT TGC CCA GGC |
| Op-m155-L68A-R | 89 | TAA AAG AGA ACA GGC TCA TAT CCG CGG GCT CGT CAA ACT TGC CCA G |
| op-311A-m156 | 90 | ACC AGG ATC GTG TTT ACA GAC GCG GTG CTG AAG TTC CTG TCC |
| op-312A-m157 | 91 | AGG ATC GTG TTT ACA GAC CAG GCG CTG AAG TTC CTG TCC CAG |
| op-313A-m158 | 92 | ATC GTG TTT ACA GAC CAG GTG GCG AAG TTC CTG TCC CAG GAT |
| op-314A-m159 | 93 | ATC GTG TTT ACA GAC CAG GTG CTG GCG TTC CTG TCC CAG GAT GAG |

TABLE 5-continued

Primer sequences used for cloning of PH20
variants

| Primer | SEQ ID NO | Nucleotide sequence (5'->3') |
|---|---|---|
| N266A-m160 | 94 | GCC CTG TAC CCT AGC ATC TAT CTG GCC ACC CAG CAG AGC CCA GTG GC |
| T267A-m161 | 95 | CTG TAC CCT AGC ATC TAT CTG AAC GCC CAG CAG AGC CCA GTG GCC GCT AC |
| Q268A-m162 | 96 | TAC CCT AGC ATC TAT CTG AAC ACC GCG CAG AGC CCA GTG GCC GCT ACA CTG |
| Q269A-m163 | 97 | TAC CCT AGC ATC TAT CTG AAC ACC CAG GCG AGC CCA GTG GCC GCT ACA CTG TAT G |
| P271A-m164 | 98 | AGC ATC TAT CTG AAC ACC CAG CAG AGC GCA GTG GCC GCT ACA CTG TAT GTG AGG |
| V272A-m165 | 99 | TAT CTG AAC ACC CAG CAG AGC CCA GCG GCC GCT ACA CTG TAT GTG AGG |
| Op-m166-I102A-R | 100 | TGT CAC TCC GGT GAT AGA ATC GGC ATA TGG ATA GTA GCC CAG TCT G |
| Op-m167-D103A-R | 101 | TCA CTG TCA CTC CGG TGA TAG AAG CGA TAT ATG GAT AGT AGC CCA G |
| Op-m168-S104A-R | 102 | TCC GTT CAC TGT CAC TCC GGT GAT AGC ATC GAT ATA TGG ATA GTA GCC CAG |
| Op-m169-I105A-R | 103 | TCC GTT CAC TGT CAC TCC GGT GGC AGA ATC GAT ATA TGG ATA GTA GC |
| op-m170-T132A-R | 104 | TTG TCC ACT GGC ATG TAG AAG GCG ATG TCC TTC TTA GCC TTA TC |
| op-m171-F133A-R | 105 | TGC CCA GAT TGT CCA CTG GCA TGT AGG CGG TGA TGT CCT TCT TAG CCT TAT C |
| op-m172-Y134A-R | 106 | TGC CCA GAT TGT CCA CTG GCA TGG CGA AGG TGA TGT CCT TCT TAG |
| V241A-m173 | 107 | AGA TCG TCG TTC CTC TTG ATC TCC GCA TTG AAA CAG GAG CCG TTG TAG CC |
| E242A-m174 | 108 | GAC AGA TCG TCG TTC CTC TTG ATC GCC ACA TTG AAA CAG GAG CCG TTG TAG CC |
| I243A-m175 | 109 | AGC CAA GAC AGA TCG TCG TTC CTC TTG GCC TCC ACA TTG AAA CAG GAG CCG TTG |
| K244A-m176 | 110 | AGC CAA GAC AGA TCG TCG TTC CTC GCG ATC TCC ACA TTG AAA CAG GAG CCG |
| Op-m177-L179A-R | 111 | TCT GTG GCC TCG GTC AGG CTC GCC TGC ACG TTC TGC TGC TGC AC |
| Op-m178-S180A-R | 112 | TTC TCT GTG GCC TCG GTC AGG GCC AGC TGC ACG TTC TGC TGC TG |
| Op-m179-L181A-R | 113 | TAG CCT TCT CTG TGG CCT CGG TCG CGC TCA GCT GCA CGT TCT GCT G |
| Op-m180-T182A-R | 114 | TTA GCC TTC TCT GTG GCC TCG GCC AGG CTC AGC TGC ACG TTC TG |
| Op-m181-T185A-R | 115 | TCG AAC TCC TGC TTA GCC TTC TCT GCG GCC TCG GTC AGG CTC AGC TG |
| Op-m182-E186A-R | 116 | TCG AAC TCC TGC TTA GCC TTC GCT GTG GCC TCG GTC AGG CTC AG |
| Op-m183-K187A-R | 117 | TTC TCG AAC TCC TGC TTA GCC GCC TCT GTG GCC TCG GTC AGG C |

TABLE 5-continued

Primer sequences used for cloning of PH20
variants

| Primer | SEQ ID NO | Nucleotide sequence (5'->3') |
|---|---|---|
| op-K290A-m184 | 118 | AGA GAG GCT ATC CGC GTG TCT GCG ATC CCC GAC GCC AAG TCC CCA C |
| op-I291A-m185 | 119 | AGG CTA TCC GCG TGT CTA AGG CCC CCG ACG CCA AGT CCC CAC TG |
| op-P292A-m186 | 120 | AGG CTA TCC GCG TGT CTA AGA TCG CCG ACG CCA AGT CCC CAC TGC CC |
| L441A-m190 | 121 | AGT TTT ACT GCT CTT GTT ATT CCA CCG CGA GCT GTA AGG AGA AGG CTG ATG |
| S442A-m191 | 122 | ACT GCT CTT GTT ATT CCA CCC TGG CCT GTA AGG AGA AGG CTG ATG TG |
| op-D451A-m192 | 123 | AAG GAG AAG GCT GAT GTG AAG GCC ACA GAT GCC GTG GAC GTG TGC |
| op-T452A-m193 | 124 | AAG GAG AAG GCT GAT GTG AAG GAC GCA GAT GCC GTG GAC GTG TGC ATC |
| op-D453A-m194 | 125 | AAG GCT GAT GTG AAG GAC ACA GCT GCC GTG GAC GTG TGC ATC G |
| op-D461A-6H-not | 126 | ATA TTC GCG GCC GCC TAT TAG TGG TGA TGG TGA TGA TGA AAG GCG TCG ATG CAC ACG CCA GCA GCG ATG CAC ACG TCC ACG |
| op-G462A-6H-not | 127 | ATA TTC GCG GCC GCC TAT TAG TGG TGA TGG TGA TGA TGA AAG GCG TCG ATG CAC ACG GCA TCA GCG ATG CAC ACG TCC AC |
| op-V463A-6H-not | 128 | ATA TTC GCG GCC GCC TAT TAG TGG TGA TGG TGA TGA TGA AAG GCG TCG ATG CAC GCG CCA TCA GCG ATG CAC ACG |
| op-N82A-m198-R | 129 | TGT CAC GCC CTG GCC GGT GGC AGC GAT CCG AGG AGA GCC GAT AAA AG |
| op-N166A-m199-R | 130 | TGC ACC AGC TCG ATG GAC CGA GCC TTA TAC ACG TCC TTA GGC TTC |
| Op-S104N-m203-R | 131 | TTC ACT GTC ACT CCG GTG ATA TTA TCG ATA TAT GGA TAG TAG CC |
| Op-I105Q-m204-R | 132 | TCC GTT CAC TGT CAC TCC GGT CTG AGA ATC GAT ATA TGG ATA GTA GC |
| op-Q268D-m205-F | 133 | ACC CTA GCA TCT ATC TGA ACA CCG ATC AGA GCC CAG TGG CCG CTA C |
| op-Q268I-m208-F | 134 | ACC CTA GCA TCT ATC TGA ACA CCA TCC AGA GCC CAG TGG CCG CTA C |
| op-291G-m210-F | 135 | AGG CTA TCC GCG TGT CTA AGG GCC CCG ACG CCA AGT CCC CAC |
| op-292D-m211-F | 136 | ATC CGC GTG TCT AAG ATC GAC GAC GCC AAG TCC CCA CTG C |
| op-T452D-m212 | 137 | AGA AGG CTG ATG TGA AGG ACG ACG ATG CCG TGG ACG TGT G |
| op-T452H-m213 | 138 | AGA AGG CTG ATG TGA AGG ACC ACG ATG CCG TGG ACG TGT G |
| op-T452K-m214 | 139 | AGA AGG CTG ATG TGA AGG ACA AAG ATG CCG TGG ACG TGT G |
| Op-T452G-m216 | 140 | AGA AGG CTG ATG TGA AGG ACG GAG ATG CCG TGG ACG TGT G |

TABLE 5-continued

Primer sequences used for cloning of PH20
variants

| Primer | SEQ ID NO | Nucleotide sequence (5'->3') |
|---|---|---|
| Op-T452P-m217 | 141 | AGA AGG CTG ATG TGA AGG ACC CAG ATG CCG TGG ACG TGT G |
| op-T452M-m218 | 142 | AGA AGG CTG ATG TGA AGG ACA TGG ATG CCG TGG ACG TGT G |
| op-T452F-m219 | 143 | AGA AGG CTG ATG TGA AGG ACT TCG ATG CCG TGG ACG TGT G |
| op-D461R-6H-not-m220 | 144 | CTC TAA TTG CGG CCG CCT ATT AGT GGT GAT GGT GAT GAT GAA AGG CGT CGA TGC ACA CGC CCC TAG CGA TGC ACA CGT CCA C |
| op-V463Y-6H-not-m231 | 145 | CTC TAA TTG CGG CCG CTC ATT AGT GGT GAT GGT GAT GAT GAA AGG CGT CGA TGC AGT AGC CAT CAG CGA TGC ACA C |
| op-S180T-R-m232 | 146 | TTC TCT GTG GCC TCG GTC AGG GTC AGC TGC ACG TTC TGC TGC TG |
| op-D451S-F-m233 | 147 | AGG AGA AGG CTG ATG TGA AGA GCA CAG ATG CCG TGG ACG TG |
| op-L313P-m234-F | 148 | ATC GTG TTT ACA GAC CAG GTG CCG AAG TTC CTG TCC CAG GAT GAG |
| op-L313M-m235-F | 149 | ATC GTG TTT ACA GAC CAG GTG ATG AAG TTC CTG TCC CAG GAT GAG |
| op-L179S-m243-R | 150 | TCT GTG GCC TCG GTC AGG CTC GAC TGC ACG TTC TGC TGC AC |
| op-L179I-m245-R | 151 | TCT GTG GCC TCG GTC AGG CTA ATC TGC ACG TTC TGC TGC AC |
| op-L179F-m246-R | 152 | TCT GTG GCC TCG GTC AGG CTA AAC TGC ACG TTC TGC TGC AC |
| FQQ-Mega-m254 | 153 | ATC GTG ATC TGG GGC TCC TGG GAG TTC ACC AGG ACC CAG GAG AGC TGC CAG GCC ATC CAG GAG TAC ATG GAC ACA ACC CTG AAC |
| op-Q268N-m259-m | 154 | ACC CTA GCA TCT ATC TGA ACA CCA ACC AGA GCC CAG TGG CCG CTA C |
| B4-124-R | 155 | GCC CAG GCA GAA CTC GC |
| op-L181M, E186D-m266 | 156 | TCT CGA ACT CCT GCT TAG CCT TAT CTG TGG CCT CGG TCA TGC TCA GCT GCA CGT TCT GCT GC |
| op-Q268A-m268-m | 157 | ACC CTA GCA TCT ATC TGA ACA CCG CGC AGA GCC CAG TGG CCG CTA C |
| op-344I, 348M-m271 | 158 | ATC GTG ATC TGG GGC TCC TGG GAG ATC ACC AGG ACC ATG GAG AGC TGC CAG GCC ATC AAG |
| op-DLSS-m275 | 159 | AGC GGC ATC GTG ATC TGG GGC GAC CTG TCG ATC TCC TCG ACC ATG GAG AGC TGC CAG GCC |
| op-DLS-m276 | 160 | AGC GGC ATC GTG ATC TGG GGC GAC CTG TCG ATC TCC AGG ACC ATG GAG AGC TGC CAG |
| Op-K348M-m279 | 161 | ATC TGG GGC TCC TGG GAG AAC ACC AGG ACC ATG GAG AGC TGC CAG GCC ATC AAG |
| Op-N344I K348M-m280 | 162 | ATC GTG ATC TGG GGC TCC TGG GAG ATC ACC AGG ACC ATG GAG AGC TGC CAG GCC ATC AAG |

After finding a PH20 variant with increased enzymatic activity and thermal stability, the His-tag-free cDNA of the PH20 variant was also constructed.

The PH20 variant was constructed as follows using cDNA of the PH20 variant.

The expression of the variant was performed using the EXPICHO™ expression system. When the cell density of EXPICHO™ cells reached $6\times10^6$/mL, a plasmid including the wild-type or variant PH20 cDNA inserted in the pcDNA3.4-TOPO vector was transfected into the EXPICHO™ cells using EXPIFECTAMINE™ CHO reagent. As a cell culture medium, EXPICHO™ expression medium (100 to 500 mL) was used. After transfection, the EXPICHO™ cells were cultured with shaking at 130 rpm for a total of 6 days, during which the cells were cultured at 37° C. for 1 day and were further cultured at a lower temperature of 32° C. for 5 days. After completion of the culture, the cell supernatant was collected by centrifugation at 10,000 rpm for 30 min.

The recombinant proteins of the C-terminal His-tag-attached wild-type PH20 and variant PH20, produced in the EXPICHO™ cells, were purified through three-step column chromatography using an AKTA™ prime system (GE Healthcare Systems), and the three-step column chromatography was performed using a HisTrap HP column-Q Sepharose column-phenyl HP column, and a Q Sepharose column-HisTrap HP column-butyl HP column, respectively, depending on the variant.

The purification using the HisTrap HP column, the Q Sepharose column and the phenyl HP column was performed as follows. For protein purification using the His-Trap column, buffer A (20 mM sodium phosphate, pH 7.5, 0.5 M NaCl) and buffer B (20 mM sodium phosphate, pH 7.5, 0.5 M NaCl, 0.5 M imidazole) were prepared. The protein was bound to the HisTrap column, and the column was flushed with 5 column volumes (CV) of buffer A to remove non-specifically bound proteins. It was confirmed that the conductivity was maintained at a constant level, and then the column was flushed with 5 CV of 20% buffer B to elute the protein. The eluted protein was dialyzed with dialysis buffer (20 mM sodium phosphate, pH 7.5, 50 mM NaCl). For protein purification using the Q Sepharose column, buffer A (20 mM sodium phosphate, pH 7.5) and buffer B (20 mM sodium phosphate, pH 7.5, 0.5 M NaCl) were prepared. The protein was bound to the Q Sepharose column, and the column was flushed with 5 CV of buffer A to remove nonspecifically bound proteins, and then was flushed with 5 CV of buffer B at a concentration gradient of 0 to 100% to elute the protein. For protein purification using the phenyl HP column, buffer A (20 mM sodium phosphate, pH 7.0, 1.5 M $(NH_4)_2SO_4$) and buffer B (20 mM sodium phosphate, pH 7.0) were prepared. The protein was bound to the phenyl column, and the column was flushed with 5 CV of buffer A to remove nonspecifically bound proteins, and then was flushed with 5 CV of buffer B at a concentration gradient of 0 to 100% to elute the protein.

The purification using the Q Sepharose column, the HisTrap HP column and the butyl HP column was performed as follows. For protein purification using the Q Sepharose column, buffer A (20 mM NaPi, 15 mM NaCl, pH 8.0) and buffer B (20 mM NaPi, 500 mM NaCl, pH 8.0) were prepared. To adjust the pH and conductivity of the culture solution to be the same as Buffer A, the pH was titrated to 8 using 1 M Tris buffer, and the conductivity was adjusted to 5 mS/cm or less by adding water (PW) thereto. Then, the culture solution was filtered through a membrane having 0.22-μm pores therein. The protein was bound to the Q Sepharose column, and the column was flushed with 5 CV of buffer A to remove nonspecifically bound proteins and was then flushed with 5 CV of buffer B to elute the target protein. For protein purification using the HisTrap HP column, buffer A (20 mM NaPi, 500 mM NaCl, pH 7.5) and buffer B (20 mM NaPi, 500 mM NaCl, 500 mM Imidazole, pH 7.5) were prepared. The protein sample was bound to the HisTrap HP column, the column was flushed with 10 CV of 7% buffer B to remove non-specifically bound proteins, and the column was then flushed with 3 CV of 40% buffer B to elute the protein. For protein purification using the butyl HP column, buffer A (20 mM NaPi, 1.5 M Ammonium sulfate, pH 7.0) and buffer B (20 mM NaPi, pH 7.0) were prepared. A 3 M ammonium sulfate solution and a protein sample to be loaded onto the column were mixed in a ratio of 1:1 and then the resulting mixture was filtered through a membrane having 0.22-μm pores therein. The protein sample was bound to the butyl HP column, and the column was flushed with 5 CV of buffer A to remove impurities. Then, the target protein was eluted with a linear concentration gradient of 0-100% buffer B, and was dialyzed using a dialysis buffer (20 mM NaPi, 100 mM NaCl, pH 7.0). The variant according to the present invention was purified by the method suggested in the present invention, 10% SDS-PAGE analysis was performed on each purified product, and the results are shown in FIGS. 1 and 3.

The enzymatic activities of wild-type PH20 and variant PH20 were measured by turbidimetric assay.

The turbidimetric assay is a method of measuring the absorbance in the precipitate that is produced when hyaluronic acid is mixed with albumin (BSA). When hyaluronic acid is hydrolyzed by PH20, the absorbance of the precipitate that is produced upon mixing with albumin decreases. The turbidimetric assay is generally performed as follows. Hyaluronidase PH20 (Sigma) was diluted to 1, 2, 5, 7.5, 10, 15, 20, 30, 50 and 60 units/mL and prepared in each tube. The purified protein sample was dissolved in an enzyme diluent buffer (20 mM Tris-HCl, pH 7.0, 77 mM NaCl, 0.01% (w/v) bovine serum albumin), diluted to 100×, 300×, 600×, 1200× and 2400×, and prepared in respective tubes. In fresh tubes, the hyaluronic acid solution having a concentration of 3 mg/mL was diluted 10-fold to a concentration of 0.3 mg/mL so that the volume in each tube became 180 μL. 60 μL of enzyme was added to and mixed with the diluted hyaluronic acid solution and allowed to react at 37° C. for 45 minutes. After completion of the reaction, 50 μL of the reacted enzyme and 250 μL of acidic albumin solution were added to each well of a 96-well plate and shaken for 10 minutes, and then the absorbance was measured at 600 nm using a spectrophotometer.

Methods of measuring the thermal stability of the protein include a method of measuring the aggregation temperature by dynamic light scattering (DLS), a method of measuring the melting temperature ($T_m$) in real-time PCR using Sypro-Orange dye, and a method of measuring the enzymatic activity after allowing the protein to stand at a predetermined temperature for a predetermined time, etc. In the method of measuring the aggregation temperature by DLS, the aggregation of molecules is measured using light scattering, and thus the sensitivity is high and the aggregation temperature is generally lower than the melting temperature of the protein. Since each variant is prepared as a solution of the same concentration of 0.2 mg/mL and is then measured, the physical properties of each variant can be compared using the resulting value as the aggregation temperature (Philo, J. S. (2009) Cur. Pharm. Biotech. 10, 359-372).

The amino acid sequences of the PH20 variants constructed by substitution or cleavage of the amino acids from the PH20 variant having the sequence of SEQ ID NO: 3 in the present invention are shown in Table 6 below.

In the present invention, the experiment was conducted on a variant in which six histidines were added for protein purification at the C-terminus in the sequence shown in Table 6. It was found that this addition to the C-terminus did not affect the enzyme activity or protein stability. The variant according to the present invention was named as a combination of HM and serial number, and the variants according to Example 3 were named "Hyal2-variant", "Hyal3-variant", and "Hyal4-variant".

TABLE 6

Amino acid sequences of PH20 variants according to present invention and substitution/cleavage characteristics thereof

| Name | SEQ ID NO | Substitution | Sequence |
|---|---|---|---|
| Hyal2-variant | 163 | 15 amino acid residues S341T, W342L, E343S, N344I, R346T, T347S, K348T, S350T, A353Y, I354L, E356D, M358L, D359T and T360R, T361L are substituted from SEQ ID NO: 3, cleavage occurs before amino acid residue L36 at N-terminus of PH20, and cleavage occurs after amino acid residue S490 at C-terminus of PH20. | LNFRAPPVIPNVPFLWAWNAPSEFCLGKF DEPLDMSLFSFIGSPRINATGQGVTIFYVD RLGYYPYIDSITGVTVNGGIPQKISLQDHL DKAKKDITFYMPVDNLGMAVIDWEEWR PTWARNWKPKDVYKNRSIELVQQQNVQ LSLTEATEKAKQEFEKAGKDFLVETIKLG KLLRPNHLWGYYLFPDCYNHHYKKPGY NGSCFNVEIKRNDDLSWLWNESTALYPSI YLNTQQSPVAATLYVRNRVREAIRVSKIP DAKSPLPVFAYTRIVFTDQVLKFLSQDEL VYTFGETVALGASGIVIWGTLSITTSTET CQYLKDYLTRLLNPYIINVTLAAKMCSQ VLCQEQGVCIRKNWNSSDYLHLNPDNFA IQLEKGGKFTVRGKPTLEDLEQFSEKFYC SCYSTLSCKEKADVKDTDAVDVCIADGV CIDAFLKPPMETEEPQIFYNASPSTLS |
| Hyal3-variant | 164 | 17 amino acid residues S341T, W342L, E343S, N344I, T345S, R346S, T347S, K348E, S350E, Q352W, A353H, I354L, K355H, E356D, M358L, D359V and T360D are substituted from SEQ ID NO: 3, cleavage occurs before amino acid residue L36 at N-terminus of PH20, and cleavage occurs after amino acid residue S490 at C-terminus of PH20. | LNFRAPPVIPNVPFLWAWNAPSEFCLGKF DEPLDMSLFSFIGSPRINATGQGVTIFYVD RLGYYPYIDSITGVTVNGGIPQKISLQDHL DKAKKDITFYMPVDNLGMAVIDWEEWR PTWARNWKPKDVYKNRSIELVQQQNVQ LSLTEATEKAKQEFEKAGKDFLVETIKLG KLLRPNHLWGYYLFPDCYNHHYKKPGY NGSCFNVEIKRNDDLSWLWNESTALYPSI YLNTQQSPVAATLYVRNRVREAIRVSKIP DAKSPLPVFAYTRIVFTDQVLKFLSQDEL VYTFGETVALGASGIVIWGTLSISSSEEEC WHLHDYLVDTLNPYIINVTLAAKMCSQV LCQEQGVCIRKNWNSSDYLHLNPDNFAI QLEKGGKFTVRGKPTLEDLEQFSEKFYCS CYSTLSCKEKADVKDTDAVDVCIADGVC IDAFLKPPMETEEPQIFYNASPSTLS |
| Hyal4-variant | 165 | 17 amino acid residues S341T, W342L, E343S, N344I, R346A, T347S, E349A, S350N, Q352T, A353K, I354V, E356Q, Y357F, M358V, D359S, T360S and T361D are substituted from SEQ ID NO: 3, cleavage occurs before amino acid residue L36 at N-terminus of PH20, and cleavage occurs after amino acid residue S490 at C-terminus of PH20. | LNFRAPPVIPNVPFLWAWNAPSEFCLGKF DEPLDMSLFSFIGSPRINATGQGVTIFYVD RLGYYPYIDSITGVTVNGGIPQKISLQDHL DKAKKDITFYMPVDNLGMAVIDWEEWR PTWARNWKPKDVYKNRSIELVQQQNVQ LSLTEATEKAKQEFEKAGKDFLVETIKLG KLLRPNHLWGYYLFPDCYNHHYKKPGY NGSCFNVEIKRNDDLSWLWNESTALYPSI YLNTQQSPVAATLYVRNRVREAIRVSKIP DAKSPLPVFAYTRIVFTDQVLKFLSQDEL VYTFGETVALGASGIVIWGTLSITASKAN CTKVKQFVSSDLNPYIINVTLAAKMCSQ VLCQEQGVCIRKNWNSSDYLHLNPDNFA IQLEKGGKFTVRGKPTLEDLEQFSEKFYC SCYSTLSCKEKADVKDTDAVDVCIADGV CIDAFLKPPMETEEPQIFYNASPSTLS |
| HM63 | 166 | One amino acid residue R346M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTMTKESC QAIKEYMDTTLNPYIINVTLAAKMCSQVL CQEQGVCIRKNWNSSDYLHLNPDNFAIQ |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | LEKGGKFTVRGKPTLEDLEQFSEKFYCSC YSTLSCKEKADVKDTDAVDVCIADGVCI DAF |
| HM64 | 167 | One amino acid residue T347Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTR<u>Q</u>KESC QAIKEYMDTTLNPYIINVTLAAK<u>M</u>CSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM65 | 168 | One amino acid residue K348Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRT<u>Q</u>ESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM66 | 169 | One amino acid residue S350Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKE<u>Q</u>C QAIKEYMDTTLNPYIINVTLAAKMCS<u>Q</u>VL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM67 | 170 | One amino acid residue K355Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AI<u>Q</u>EYMDTTLNPYIINVTLAAKMCSQVLC QE<u>Q</u>GVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|---|---|---|---|
| HM69 | 171 | One amino acid residue M358V is substituted from SEQ ID NO: 3, cleavage occurs before F38 amino acid residue at N-terminus of PH20 and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYVDTTLNPYIINVTLAAKMCSQVLC QEQGV$\overline{\text{C}}$IRKNWNSSDYLHLNPDNFAIQLE KGGKFTVRGKPTLEDLEQFSEKFYCSCYS TLSCKEKADVKDTDAVDVCIADGVCIDA F |
| HM70 | 172 | One amino acid residue L362A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTANPYIINVTLAAKMCSQVLC QEQGVCIRK$\overline{\text{N}}$WNSSDYLHLNPDNFAIQLE KGGKFTVRGKPTLEDLEQFSEKFYCSCYS TLSCKEKADVKDTDAVDVCIADGVCIDA F |
| HM71 | 173 | One amino acid residue E343 V is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWVNTRTKESCQ AIKEYMDTTLNPYIINVTL$\overline{\text{A}}$AKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM72 | 174 | One amino acid residue N344F is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWEFTRTKESCQ AIKEYMDTTLNPYIINVTLA$\overline{\text{A}}$KMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM73 | 175 | One amino acid residue D359K is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMKTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM74 | 176 | One amino acid residue T360Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDYTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM75 | 177 | One amino acid residue T361M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTMLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM76 | 178 | One amino acid residue Q352E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCE AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM77 | 179 | One amino acid residue N363M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|---|---|---|---|
| | | | TFGETVALGASGIVIWGSWENTRTKESCQ AIKEYMDTTLMPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM78 | 180 | One amino acid residue T84N is substituted from SEQ ID NO: 3, residue cleavage occurs before F38 amino acid at N-terminus of PH20, and cleavage occurs after F468 amino acid residue at C-terminus of PH20. | FRAPPVIPNVPFLWAWNAPSEFCLGKFDE PLDMSLFSFIGSPRINANGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM79 | 181 | One amino acid residue N166K is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKKRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM82 | 182 | One amino acid residue I354E is substituted from SEQ ID NO: 3, residue cleavage occurs before F38 amino acid at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AEKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM83 | 183 | One amino acid residue I354Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AQKEYMDTTLNPYIINVTLAAKMCSQVL |

TABLE 6-continued

Amino acid sequences of PH20 variants according to present
invention and substitution/cleavage characteristics thereof

| Name | SEQ ID NO | Substitution | Sequence |
|---|---|---|---|
| | | | CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM84 | 184 | One amino acid residue I354S is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ ASKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM85 | 185 | One amino acid residue I354V is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AVKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM86 | 186 | One amino acid residue I354A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AAKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM88 | 187 | One amino acid residue I354N is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ ANKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |

TABLE 6-continued

Amino acid sequences of PH20 variants according to present
invention and substitution/cleavage characteristics thereof

| Name | SEQ ID NO | Substitution | Sequence |
|---|---|---|---|
| HM89 | 188 | One amino acid residue I354T is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AT<u>T</u>KEYMDTTLNPYIINVTLAAKMCSQVL CQ<u>E</u>QGVCIRKNWNSSDYLHLNPDNFAIQ LEKGGKFTVRGKPTLEDLEQFSEKFYCSC YSTLSCKEKADVKDTDAVDVCIADGVCI DAF |
| HM90 | 189 | One amino acid residue E356M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIK<u>M</u>YMDTTLNPYIINVTLAAKMCSQVL CQ<u>E</u>QGVCIRKNWNSSDYLHLNPDNFAIQ LEKGGKFTVRGKPTLEDLEQFSEKFYCSC YSTLSCKEKADVKDTDAVDVCIADGVCI DAF |
| HM91 | 190 | One amino acid residue E356F is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIK<u>F</u>YMDTTLNPYIINVTLAAKMCSQVLC QEQ<u>G</u>VCIRKNWNSSDYLHLNPDNFAIQLE KGGKFTVRGKPTLEDLEQFSEKFYCSCYS TLSCKEKADVKDTDAVDVCIADGVCIDA F |
| HM92 | 191 | One amino acid residue E356I is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIK<u>I</u>YMDTTLNPYIINVTLAAKMCSQVLC QEQ<u>G</u>VCIRKNWNSSDYLHLNPDNFAIQLE KGGKFTVRGKPTLEDLEQFSEKFYCSCYS TLSCKEKADVKDTDAVDVCIADGVCIDA F |
| HM93 | 192 | One amino acid residue E356L is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|---|---|---|---|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKLYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM94 | 193 | One amino acid residue E356Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKQYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM95 | 194 | One amino acid residue E356V is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKVYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM96 | 195 | 3 amino acid residues N166K, E343V and T361M are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKKRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWVNTRTKESCQ AIKEYMDTMLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM97 | 196 | One amino acid residue G340Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | TFGETVALGASGIVIW<u>Q</u>SWENTRTKESCQ AIKEYMDTTLNPYIIN<u>V</u>TLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM98 | 197 | One amino acid residue S341H is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWG<u>H</u>WENTRTKESC QAIKEYMDTTLNPYIIN<u>V</u>TLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM99 | 198 | One amino acid residue W342I is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGS<u>I</u>ENTRTKESCQ AIKEYMDTTLNPYIINVT<u>L</u>AAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM100 | 199 | One amino acid residue E343Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSW<u>Y</u>NTRTKESCQ AIKEYMDTTLNPYIINVTL<u>A</u>AKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM101 | 200 | One amino acid residue T345E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWEN<u>E</u>RTKESCQ AIKEYMDTTLNPYIINVTLAAKMCSQVLC QEQGVCIRKNWNSSDYLHLNPDNFAIQLE |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | KGGKFTVRGKPTLEDLEQFSEKFYCSCYS TLSCKEKADVKDTDAVDVCIADGVCIDA F |
| HM102 | 201 | One amino acid residue R346F is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTFTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM103 | 202 | One amino acid residue T347E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTREKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM104 | 203 | One amino acid residue E349L is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKLSCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM105 | 204 | One amino acid residue S350I is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKEICQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| HM106 | 205 | One amino acid residue Q352G is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCG AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM107 | 206 | One amino acid residue I354R is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ ARKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM110 | 207 | One amino acid residue M358R is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYRDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM111 | 208 | One amino acid residue D359V is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMVTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM112 | 209 | One amino acid residue T360R is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|---|---|---|---|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDRTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM114 | 210 | One amino acid residue T345K is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENKRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM115 | 211 | One amino acid residue R346L is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTLTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM116 | 212 | One amino acid residue T347V is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRVKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM117 | 213 | One amino acid residue E349W is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | TFGETVALGASGIVIWGSWENTRTKWSC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM118 | 214 | One amino acid residue I354W is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AWKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM121 | 215 | One amino acid residue D359Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMYTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM125 | 216 | One amino acid residue T347W is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRWKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM126 | 217 | One amino acid residue Y357W is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEWMDTTLNPYIINVTLAAKMCSQVL |

TABLE 6-continued

Amino acid sequences of PH20 variants according to present
invention and substitution/cleavage characteristics thereof

| Name | SEQ ID NO | Substitution | Sequence |
|---|---|---|---|
| | | | CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM130 | 218 | One amino acid residue W342D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSDENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM131 | 219 | One amino acid residue E343Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWQNTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM132 | 220 | One amino acid residue T347H is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRHKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM133 | 221 | One amino acid residue K348F is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTFESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present invention and substitution/cleavage characteristics thereof

| Name | SEQ ID NO | Substitution | Sequence |
|---|---|---|---|
| HM134 | 222 | One amino acid residue S350D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKEDC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM135 | 223 | One amino acid residue Q352Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCY AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM136 | 224 | One amino acid residue A353E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ EIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM138 | 225 | One amino acid residue M358Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYYDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM139 | 226 | One amino acid residue D359Q is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|---|---|---|---|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMQTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM140 | 227 | One amino acid residue T360L is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDLTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM141 | 228 | One amino acid residue T361E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTELNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM142 | 229 | One amino acid residue N363E is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLEPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM143 | 230 | One amino acid residue W342H is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|---|---|---|---|
| | | | TFGETVALGASGIVIWGSHENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM144 | 231 | One amino acid residue K348D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTDESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM145 | 232 | One amino acid residue T361H is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTHLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM146 | 233 | No additional substitution occurs, cleavage occurs before R39 amino acid residue at N-terminus of PH20, and cleavage occurs after F468 amino acid residue at C-terminus of PH20. | RAPPVIPNVPFLWAWNAPSEFCLGKFDEP LDMSLFSFIGSPRINATGQGVTIFYVDRLG YYPYIDSITGVTVNGGIPQKISLQDHLDKA KKDITFYMPVDNLGMAVIDWEEWRPTW ARNWKPKDVYKNRSIELVQQQNVQLSLT EATEKAKQEFEKAGKDFLVETIKLGKLLR PNHLWGYYLFPDCYNHHYKKPGYNGSC FNVEIKRNDDLSWLWNESTALYPSIYLNT QQSPVAATLYVRNRVREAIRVSKIPDAKS PLPVFAYTRIVFTDQVLKFLSQDELVYTF GETVALGASGIVIWGSWENTRTKESCQAI KEYMDTTLNPYIINVTLAAKMCSQVLCQ EQGVCIRKNWNSSDYLHLNPDNFAIQLEK GGKFTVRGKPTLEDLEQFSEKFYCSCYST LSCKEKADVKDTDAVDVCIADGVCIDAF |
| HM147 | 234 | No additional substitution occurs, cleavage occurs before A40 amino acid residue at N-terminus of PH20, and cleavage occurs after F468 amino acid residue at C-terminus of PH20. | APPVIPNVPFLWAWNAPSEFCLGKFDEPL DMSLFSFIGSPRINATGQGVTIFYVDRLGY YPYIDSITGVTVNGGIPQKISLQDHLDKAK KDITFYMPVDNLGMAVIDWEEWRPTWA RNWKPKDVYKNRSIELVQQQNVQLSLTE ATEKAKQEFEKAGKDFLVETIKLGKLLRP NHLWGYYLFPDCYNHHYKKPGYNGSCF NVEIKRNDDLSWLWNESTALYPSIYLNTQ QSPVAATLYVRNRVREAIRVSKIPDAKSP LPVFAYTRIVFTDQVLKFLSQDELVYTFG ETVALGASGIVIWGSWENTRTKESCQAIK EYMDTTLNPYIINVTLAAKMCSQVLCQE QGVCIRKNWNSSDYLHLNPDNFAIQLEK GGKFTVRGKPTLEDLEQFSEKFYCSCYST LSCKEKADVKDTDAVDVCIADGVCIDAF |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| HM149 | 235 | No additional substitution occurs, cleavage occurs before F38 amino acid residue at N-terminus of PH20, and cleavage occurs after D456 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVD |
| HM150 | 236 | 2 amino acid residues S350Q and T360R are substituted from SEQ ID NO: 3, cleavage occurs before R39 amino acid residue at N-terminus of PH20, and cleavage occurs after F468 amino acid residue at C-terminus of PH20. | RAPPVIPNVPFLWAWNAPSEFCLGKFDEP LDMSLFSFIGSPRINATGQGVTIFYVDRLG YYPYIDSITGVTVNGGIPQKISLQDHLDKA KKDITFYMPVDNLGMAVIDWEEWRPTW ARNWKPKDVYKNRSIELVQQQNVQLSLT EATEKAKQEFEKAGKDFLVETIKLGKLLR PNHLWGYYLFPDCYNHHYKKPGYNGSC FNVEIKRNDDLSWLWNESTALYPSIYLNT QQSPVAATLYVRNRVREAIRVSKIPDAKS PLPVFAYTRIVFTDQVLKFLSQDELVYTF GETVALGASGIVIWGSWENTRTKEQCQAI KEYMDRTLNPYIINVTLAAKMCSQ<u>V</u>LCQ EQGVC<u>I</u>RKNWNSSDYLHLNPDNFAIQLEK GGKFTVRGKPTLEDLEQFSEKFYCSCYST LSCKEKADVKDTDAVDVCIADGVCIDAF |
| HM152 | 237 | One amino acid residue D65A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFA<u>E</u> PLDMSLFSFIGSPRINATGQGVTIFYV<u>D</u>RL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM153 | 238 | One amino acid residue E66A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDA PLDMSLFSFIGSPRINATGQGVTIFYV<u>D</u>RL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM154 | 239 | One amino acid residue P67A is substituted from SEQ ID NO: 3, cleavage occurs before F38 amino acid residue at N-terminus of PH20, and cleavage occurs | FRAPPVIPNVPFLWAWNAPSEFCLGKFDE ALDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG |

TABLE 6-continued

Amino acid sequences of PH20 variants according to present
invention and substitution/cleavage characteristics thereof

| Name | SEQ ID NO | Substitution | Sequence |
|------|-----------|-------------|----------|
| | | after F468 amino acid residue at C-terminus of PH20. | SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM155 | 240 | One amino acid residue L68A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PADMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM156 | 241 | One amino acid residue Q311A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDAVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM157 | 242 | One amino acid residue V312A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQALKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM158 | 243 | One amino acid residue L313A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVAKFLSQDELVY TFGETVALGASGIVIWGSWENTRTKESCQ AIKEYMDTTLNPYIINVTLAAKMCSQVLC |

TABLE 6-continued

Amino acid sequences of PH20 variants according to present
invention and substitution/cleavage characteristics thereof

| Name | SEQ ID NO | Substitution | Sequence |
|---|---|---|---|
| | | | QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM159 | 244 | One amino acid residue K314A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLAFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM160 | 245 | One amino acid residue N266A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL ATQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM161 | 246 | One amino acid residue T267A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NAAQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM162 | 247 | One amino acid residue Q268A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTAASPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|---|---|---|---|
| HM163 | 248 | One amino acid residue Q269A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQASPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM164 | 249 | One amino acid residue P271A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSAVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM165 | 250 | One amino acid residue V272A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPAAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM166 | 251 | One amino acid residue I102A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYADSITGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM167 | 252 | One amino acid residue D103A is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIASITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|---|---|---|---|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM168 | 253 | One amino acid residue S104A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDAITGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM169 | 254 | One amino acid residue I105A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSATGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM170 | 255 | One amino acid residue T132A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDIAFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM171 | 256 | One amino acid residue F133A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITAYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|---|---|---|---|
| | | | TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM172 | 257 | One amino acid residue Y134A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFAMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM173 | 258 | One amino acid residue V241A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNAEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM174 | 259 | One amino acid residue E242A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVAIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM175 | 260 | One amino acid residue I243 A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEAKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM176 | 261 | One amino acid residue K244A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIARNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM177 | 262 | One amino acid residue L179A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQAS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM178 | 263 | One amino acid residue S180A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLA LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM179 | 264 | One amino acid residue L181A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS ATEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| HM180 | 265 | One amino acid residue T182A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS L<u>A</u>EATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM181 | 266 | One amino acid residue T185A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEA<u>A</u>EKAKQEFEKAGKDFLVETIKLGKL LRPN<u>H</u>LWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM182 | 267 | One amino acid residue E186A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEAT<u>A</u>KAKQEFEKAGKDFLVETIKLGKL LRPN<u>HL</u>WGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM183 | 268 | One amino acid residue K187A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATE<u>A</u>AKQEFEKAGKDFLVETIKLGKL LRPNHL<u>W</u>GYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM184 | 269 | One amino acid residue K290A is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|---|---|---|---|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSAIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM185 | 270 | One amino acid residue I291A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKAPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM186 | 271 | One amino acid residue P292A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIADA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM190 | 272 | One amino acid residue L441A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TASCKEKADVKDTDAVDVCIADGVCIDA F |
| HM191 | 273 | One amino acid residue S442A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLACKEKADVKDTDAVDVCIADGVCIDA F |
| HM192 | 274 | One amino acid residue D451A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKATDAVDVCIADGVCIDA F |
| HM193 | 275 | One amino acid residue T452A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDADAVDVCIADGVCIDA F |
| HM194 | 276 | One amino acid residue D453A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTAAVDVCIADGVCIDA F |
| HM195 | 277 | One amino acid residue D461A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC |

TABLE 6-continued

Amino acid sequences of PH20 variants according to present
invention and substitution/cleavage characteristics thereof

| Name | SEQ ID NO | Substitution | Sequence |
|---|---|---|---|
| | | | QEQGVCIRKNWNSSDYLHLNPDNFAIQLE KGGKFTVRGKPTLEDLEQFSEKFYCSCYS TLSCKEKADVKDTDAVDVCIAAGVCIDA F |
| HM196 | 278 | One amino acid residue G462A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADAVCIDA F |
| HM197 | 279 | One amino acid residue V463A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGACIDA F |
| HM198 | 280 | One amino acid residue N82A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRIAATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM199 | 281 | One amino acid residue N166A is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKARSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|---|---|---|---|
| HM203 | 282 | One amino acid residue S104N is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDNITGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM204 | 283 | One amino acid residue I105Q is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSQTGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM205 | 284 | One amino acid residue Q268D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTDQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM208 | 285 | One amino acid residue Q268I is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTIQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM210 | 286 | One amino acid residue I291G is substituted from SEQ ID NO: 3, cleavage occurs before F38 amino acid residue | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | at N-terminus of PH20, and cleavage occurs after F468 amino acid residue at C-terminus of PH20. | LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKGPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM211 | 287 | One amino acid residue P292D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIDDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM212 | 288 | One amino acid residue T452D is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDDDAVDVCIADGVCIDA F |
| HM213 | 289 | One amino acid residue T452H is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDHDAVDVCIADGVCIDA F |
| HM214 | 290 | One amino acid residue T452K is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDKDAVDVCIADGVCIDA F |
| HM216 | 291 | One amino acid residue T452G is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDGDAVDVCIADGVCIDA F |
| HM217 | 292 | One amino acid residue T452P is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDPDAVDVCIADGVCIDA F |
| HM218 | 293 | One amino acid residue T452M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDMDAVDVCIADGVCIDA F |
| HM219 | 294 | One amino acid residue T452F is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC |

TABLE 6-continued

Amino acid sequences of PH20 variants according to present invention and substitution/cleavage characteristics thereof

| Name | SEQ ID NO | Substitution | Sequence |
|------|-----------|--------------|----------|
| | | | QEQGVCIRKNWNSSDYLHLNPDNFAIQLE KGGKFTVRGKPTLEDLEQFSEKFYCSCYS TLSCKEKADVKDFDAVDVCIADGVCIDA F |
| HM220 | 295 | One amino acid residue D461R is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIARGVCIDA F |
| HM231 | 296 | One amino acid residue V463Y is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGYCIDA F |
| HM232 | 297 | One amino acid residue S180T is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLT LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM233 | 298 | One amino acid residue D451S is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKSTDAVDVCIADGVCIDAF |

TABLE 6-continued

Amino acid sequences of PH20 variants according to present
invention and substitution/cleavage characteristics thereof

| Name | SEQ ID NO | Substitution | Sequence |
|---|---|---|---|
| HM234 | 299 | One amino acid residue L313P is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVPKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM235 | 300 | One amino acid residue L313M is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVMKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM243 | 301 | One amino acid residue L179S is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQSS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM245 | 302 | One amino acid residue L179I is substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQISL TEATEKAKQEFEKAGKDFLVETIKLGKLL RPNHLWGYYLFPDCYNHHYKKPGYNGS CFNVEIKRNDDLSWLWNESTALYPSIYLN TQQSPVAATLYVRNRVREAIRVSKIPDAK SPLPVFAYTRIVFTDQVLKFLSQDELVYTF GETVALGASGIVIWGSWENTRTKESCQAI KEYMDTTLNPYIINVTLAAKMCSQVLCQ EQGVCIRKNWNSSDYLHLNPDNFAIQLEK GGKFTVRGKPTLEDLEQFSEKFYCSCYST LSCKEKADVKDTDAVDVCIADGVCIDAF |
| HM246 | 303 | One amino acid residue L179F is substituted from SEQ ID NO: 3, cleavage occurs before F38 amino acid residue at N-terminus of PH20, | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQFS LTEATEKAKQEFEKAGKDFLVETIKLGKL |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | and cleavage occurs after F468 amino acid residue at C-terminus of PH20. | LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWENTRTKESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM254 | 304 | 3 amino acid residues N344F, K348Q and K355Q are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWEFTRTQESCQ AIQEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM261 | 305 | 7 amino acid residues T132S, L181A, E186D, Q268N, I291L, V312A, and T452D are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDISFYMPVDNLGMAVIDWEEWRPT WARNWKPKDVYKNRSIELVQQQNVQLS ATEATDKAKQEFEKAGKDFLVETIKLGK LLRPNHLWGYYLFPDCYNHHYKKPGYN GSCFNVEIKRNDDLSWLWNESTALYPSIY LNTNQSPVAATLYVRNRVREAIRVSKLPD AKSPLPVFAYTRIVFTDQALKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |
| HM262 | 306 | No additional substitution occurs, cleavage occurs before N37 amino acid residue at N-terminus of PH20, and cleavage occurs after F468 amino acid residue at C-terminus of PH20. | NFRAPPVIPNVPFLWAWNAPSEFCLGKFD EPLDMSLFSFIGSPRINATGQGVTIFYVDR LGYYPYIDSITGVTVNGGIPQKISLQDHLD KAKKDITFYMPVDNLGMAVIDWEEWRP TWARNWKPKDVYKNRSIELVQQQNVQL SLTEATEKAKQEFEKAGKDFLVETIKLGK LLRPNHLWGYYLFPDCYNHHYKKPGYN GSCFNVEIKRNDDLSWLWNESTALYPSIY LNTQQSPVAATLYVRNRVREAIRVSKIPD AKSPLPVFAYTRIVFTDQVLKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDTDAVDVCIADGVCI DAF |
| HM263 | 307 | No additional substitution occurs, cleavage occurs before L36 amino acid residue at N-terminus of PH20, and cleavage occurs after F468 amino acid residue at C-terminus of PH20. | LNFRAPPVIPNVPFLWAWNAPSEFCLGKF DEPLDMSLFSFIGSPRINATGQGVTIFYVD RLGYYPYIDSITGVTVNGGIPQKISLQDHL DKAKKDITFYMPVDNLGMAVIDWEEWR PTWARNWKPKDVYKNRSIELVQQQNVQ LSLTEATEKAKQEFEKAGKDFLVETIKLG KLLRPNHLWGYYLFPDCYNHHYKKPGY NGSCFNVEIKRNDDLSWLWNESTALYPSI YLNTQQSPVAATLYVRNRVREAIRVSKIP DAKSPLPVFAYTRIVFTDQVLKFLSQDEL VYTFGETVALGASGIVIWGSWENTRTKES |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| | | | CQAIKEYMDTTLNPYIINVTLAAKMCSQV LCQEQGVCIRKNWNSSDYLHLNPDNFAI QLEKGGKFTVRGKPTLEDLEQFSEKFYCS CYSTLSCKEKADVKDTDAVDVCIADGVC IDAF |
| HM266 | 308 | 9 amino acid residues R39K, I105A, T132S, L181M, E186D, I291L, Q268A, V312M and T452D are substituted from SEQ ID NO: 3, cleavage occurs before F38 amino acid residue at N-terminus of PH20, and cleavage occurs after F468 amino acid residue at C-terminus of PH20. | FKAPPVIPNVPFLWAWNAPSEFCLGKFDE PLDMSLFSFIGSPRINATGQGVTIFYVDRL GYYPYIDSATGVTVNGGIPQKISLQDHLD KAKKDISFYMPVDNLGMAVIDWEEWRPT WARNWKPKDVYKNRSIELVQQQNVQLS MTEATDKAKQEFEKAGKDFLVETIKLGK LLRPNHLWGYYLFPDCYNHHYKKPGYN GSCFNVEIKRNDDLSWLWNESTALYPSIY LNTAQSPVAATLYVRNRVREAIRVSKLPD AKSPLPVFAYTRIVFTDQALKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |
| HM268 | 309 | 7 amino acid residues T132A, L181A, E186A, Q268A, I291L, V312A, and T452D are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDIAFYMPVDNLGMAVIDWEEWRPT WARNWKPKDVYKNRSIELVQQQNVQLS ATEATAKAKQEFEKAGKDFLVETIKLGK LLRPNHLWGYYLFPDCYNHHYKKPGYN GSCFNVEIKRNDDLSWLWNESTALYPSIY LNTAQSPVAATLYVRNRVREAIRVSKLPD AKSPLPVFAYTRIVFTDQALKFLSQDELV YTFGETVALGASGIVIWGSWENTRTKESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |
| HM271 | 310 | 2 amino acid residues N344I and K348M are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGSWEITRTMESCQ AIKEYMDTTLNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM275 | 311 | 10 amino acid residues S341D, W342L, E343S, N344I, T345S, R346S, K348M, K355D, D359E and T361I are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGDLSISSTMESCQ AIDEYMETILNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |

TABLE 6-continued

Amino acid sequences of PH20 variants according to present
invention and substitution/cleavage characteristics thereof

| Name | SEQ ID NO | Substitution | Sequence |
|------|-----------|--------------|----------|
| HM276 | 312 | 9 amino acid residues S341D, W342L, E343S, N344I, T345S, K348M, K355D, D359E, and T361I are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDITFYMPVDNLGMAVIDWEEWRPT WARNWKPKDVYKNRSIELVQQQNVQLS LTEATEKAKQEFEKAGKDFLVETIKLGKL LRPNHLWGYYLFPDCYNHHYKKPGYNG SCFNVEIKRNDDLSWLWNESTALYPSIYL NTQQSPVAATLYVRNRVREAIRVSKIPDA KSPLPVFAYTRIVFTDQVLKFLSQDELVY TFGETVALGASGIVIWGDLSISRTMESCQ AIDEYMETILNPYIINVTLAAKMCSQVLC QEQGVCIRKNWNSSDYLHLNPDNFAIQLE KGGKFTVRGKPTLEDLEQFSEKFYCSCYS TLSCKEKADVKDTDAVDVCIADGVCIDA F |
| HM279 | 313 | 8 amino acid residues T132S, L181A, E186D, Q268N, I291L, V312A, T452D and K348M are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDISFYMPVDNLGMAVIDWEEWRPT WARNWKPKDVYKNRSIELVQQQNVQLS ATEATDKAKQEFEKAGKDFLVETIKLGK LLRPNHLWGYYLFPDCYNHHYKKPGYN GSCFNVEIKRNDDLSWLWNESTALYPSIY LNTNQSPVAATLYVRNRVREAIRVSKLPD AKSPLPVFAYTRIVFTDQALKFLSQDELV YTFGETVALGASGIVIWGSWENTRTMES CQAIKEYMDTTLNPYIINVTLAAKMCSQV LCQEQGVCIRKNWNSSDYLHLNPDNFAI QLEKGGKFTVRGKPTLEDLEQFSEKFYCS CYSTLSCKEKADVKDDDAVDVCIADGVC IDAF |
| HM280 | 314 | 9 amino acid residues T132S, L181A, E186D, Q268N, I291L, V312A, T452D, N344I, and K348M are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDISFYMPVDNLGMAVIDWEEWRPT WARNWKPKDVYKNRSIELVQQQNVQLS ATEATDKAKQEFEKAGKDFLVETIKLGK LLRPNHLWGYYLFPDCYNHHYKKPGYN GSCFNVEIKRNDDLSWLWNESTALYPSIY LNTNQSPVAATLYVRNRVREAIRVSKLPD AKSPLPVFAYTRIVFTDQALKFLSQDELV YTFGETVALGASGIVIWGSWEIRTMESC QAIKEYMDTTLNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |
| HM287 | 315 | 17 amino acid residues T132A, L181A, E186A, Q268A, I291L, V312A, S341D, W342L, E343S, N344I, T345S, R346S, K348M, K355D, D359E, T361I, and T452D are substituted from SEQ ID NO: 3, cleavage occurs before F38 amino acid residue at N-terminus of PH20, and cleavage occurs after F468 amino acid residue at C-terminus of PH20. | FRAPPVIPNVPFLWAWNAPSEFCLGKFDE PLDMSLFSFIGSPRINATGQGVTIFYVDRL GYYPYIDSITGVTVNGGIPQKISLQDHLDK AKKDIAFYMPVDNLGMAVIDWEEWRPT WARNWKPKDVYKNRSIELVQQQNVQLS ATEATAKAKQEFEKAGKDFLVETIKLGK LLRPNHLWGYYLFPDCYNHHYKKPGYN GSCFNVEIKRNDDLSWLWNESTALYPSIY LNTAQSPVAATLYVRNRVREAIRVSKLPD AKSPLPVFAYTRIVFTDQALKFLSQDELV YTFGETVALGASGIVIWGDLSISSTMESC QAIDEYMETILNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |
| HM288 | 316 | 16 amino acid residues T132A, L181A, E186A, Q268A, I291L, | FRAPPVIPNVPFLWAWNAPSEFCLGKFDE PLDMSLFSFIGSPRINATGQGVTIFYVDRL GYYPYIDSITGVTVNGGIPQKISLQDHLDK |

TABLE 6-continued

Amino acid sequences of PH20 variants according to present
invention and substitution/cleavage characteristics thereof

| Name | SEQ ID NO | Substitution | Sequence |
|---|---|---|---|
| | | V312A, S341D, W342L, E343S, N344I, T345S, K348M, K355D, D359E, T361I and T452D are substituted from SEQ ID NO: 3, cleavage occurs before F38 amino acid residue at N-terminus of PH20, and cleavage occurs after F468 amino acid residue at C-terminus of PH20. | AKKDIAFYMPVDNLGMAVIDWEEWRPT WARNWKPKDVYKNRSIELVQQQNVQLS ATEATAKAKQEFEKAGKDFLVETIKLGK LLRPNHLWGYYLFPDCYNHHYKKPGYN GSCFNVEIKRNDDLSWLWNESTALYPSIY LNTAQSPVAATLYVRNRVREAIRVSKLPD AKSPLPVFAYTRIVFTDQALKFLSQDELV YTFGETVALGASGIVIWGDLSISRTMESC QAIDEYMETILNPYIINVTLAAKMCSQVL CQEQGVCIRKNWNSSDYLHLNPDNFAIQ LEKGGKFTVRGKPTLEDLEQFSEKFYCSC YSTLSCKEKADVKDDDAVDVCIADGVCI DAF |

Example 2. Characterization of PH20 Variants According to Present Invention

Further study on the structure and function of the protein was conducted through research on variants including the cleavage at the N-terminal and C-terminal based on the amino acid sequence of SEQ ID NO: 3. As a result of the expression amount and activity analysis of the prepared variant, the aggregation temperature is shown in Table 7.

Expression level and specific activity were analyzed by the turbidimetric assay described in Example 1. The results of the assay are shown. At this time, activity in the culture solution exceeding 300 unit/mL was marked as ">LOQ", and activity after purification exceeding 15 unit/μg was marked as ">LOQ" based on the limit of quantification (LOQ) set for each of the activity in the culture solution and the activity after purification. In the opposite case, the inequality sign was changed. The expression level and limits of quantification (LOQ) of the activity analysis, and test results based thereon are shown in Table 7. The aggregation temperature of wild-type PH20 (L36-Y482) of SEQ ID NO: 1 is 46.5° C., and the aggregation temperature of the PH20 variant (F38-F468) of SEQ ID NO: 3 is 51° C.

TABLE 7

Expression level, specific activity, and aggregation
temperature of PH20 variants according to present invention

| Variants | Change from Sequence ID NO. 3 | | | Expression level (LOQ: | Specific activity (LOQ: | Aggrega-tion |
|---|---|---|---|---|---|---|
| | Amino Acid substitution | Start from | End with | 300 units/mL) | 15 units/μg) | point (° C.) |
| HM63 | R346M | F38 | F468 | >LOQ | >LOQ | 52° C. |
| HM64 | T347Q | F38 | F468 | >LOQ | >LOQ | 50° C. |
| HM65 | K348Q | F38 | F468 | >LOQ | >LOQ | 51° C. |
| HM66 | S350Q | F38 | F468 | >LOQ | >LOQ | 56° C. |
| HM67 | K355Q | F38 | F468 | >LOQ | >LOQ | 50° C. |
| HM69 | M358V | F38 | F468 | >LOQ | >LOQ | 50° C. |
| HM70 | L362A | F38 | F468 | >LOQ | >LOQ | 48° C. |
| HM71 | E343V | F38 | F468 | >LOQ | >LOQ | 50° C. |
| HM72 | N344F | F38 | F468 | >LOQ | >LOQ | 52° C. |
| HM73 | D359K | F38 | F468 | >LOQ | >LOQ | 50° C. |
| HM74 | T360Y | F38 | F468 | >LOQ | >LOQ | 50° C. |
| HM75 | T361M | F38 | F468 | >LOQ | >LOQ | 49° C. |
| HM76 | Q352E | F38 | F468 | >LOQ | >LOQ | 52° C. |
| HM77 | N363M | F38 | F468 | >LOQ | >LOQ | 58° C. |
| HM78 | T84N | F38 | F468 | >LOQ | >LOQ | 48° C. |
| HM79 | N166K | F38 | F468 | >LOQ | >LOQ | 49° C. |
| HM82 | I354E | F38 | F468 | >LOQ | >LOQ | 49° C. |
| HM83 | I354Q | F38 | F468 | >LOQ | >LOQ | 49° C. |
| HM84 | I354S | F38 | F468 | >LOQ | >LOQ | 48° C. |
| HM85 | I354V | F38 | F468 | >LOQ | >LOQ | 51° C. |
| HM86 | I354A | F38 | F468 | >LOQ | >LOQ | 49° C. |
| HM88 | I354N | F38 | F468 | >LOQ | >LOQ | 49° C. |
| HM89 | I354T | F38 | F468 | >LOQ | >LOQ | 49° C. |
| HM90 | E356M | F38 | F468 | >LOQ | >LOQ | 50° C. |
| HM91 | E356F | F38 | F468 | >LOQ | >LOQ | 49° C. |
| HM92 | E356I | F38 | F468 | >LOQ | >LOQ | 49° C. |
| HM93 | E356L | F38 | F468 | >LOQ | >LOQ | 49° C. |
| HM94 | E356Q | F38 | F468 | >LOQ | >LOQ | 50° C. |

TABLE 7-continued

Expression level, specific activity, and aggregation
temperature of PH20 variants according to present invention

| Variants | Change from Sequence ID NO. 3 | | | Expression level (LOQ: | Specific activity (LOQ: | Aggregation |
| | Amino Acid substitution | Start from | End with | 300 units/mL) | 15 units/μg) | point (° C.) |
| --- | --- | --- | --- | --- | --- | --- |
| HM95 | E356V | F38 | F468 | >LOQ | >LOQ | 48° C. |
| HM96 | N166K, E343V, T361M | F38 | F468 | >LOQ | >LOQ | 48° C. |
| HM97 | G340Q | F38 | F468 | >LOQ | >LOQ | 50° C. |
| HM98 | S341H | F38 | F468 | >LOQ | >LOQ | 51° C. |
| HM99 | W342I | F38 | F468 | >LOQ | >LOQ | 51° C. |
| HM100 | E343Y | F38 | F468 | >LOQ | >LOQ | 50° C. |
| HM101 | T345E | F38 | F468 | >LOQ | >LOQ | 51° C. |
| HM102 | R346F | F38 | F468 | >LOQ | >LOQ | 51° C. |
| HM103 | T347E | F38 | F468 | >LOQ | >LOQ | 50° C. |
| HM104 | E349L | F38 | F468 | >LOQ | >LOQ | 50° C. |
| HM105 | S350I | F38 | F468 | >LOQ | >LOQ | 50° C. |
| HM106 | Q352G | F38 | F468 | >LOQ | >LOQ | 49° C. |
| HM107 | I354R | F38 | F468 | >LOQ | >LOQ | 48° C. |
| HM110 | M358R | F38 | F468 | >LOQ | >LOQ | 48° C. |
| HM111 | D359V | F38 | F468 | >LOQ | >LOQ | 50° C. |
| HM112 | T360R | F38 | F468 | >LOQ | >LOQ | 52° C. |
| HM114 | T345K | F38 | F468 | >LOQ | >LOQ | 50° C. |
| HM115 | R346L | F38 | F468 | >LOQ | >LOQ | 52° C. |
| HM116 | T347V | F38 | F468 | >LOQ | >LOQ | 49° C. |
| HM117 | E349W | F38 | F468 | >LOQ | >LOQ | 49° C. |
| HM118 | I354W | F38 | F468 | >LOQ | >LOQ | 51° C. |
| HM121 | D359Y | F38 | F468 | >LOQ | >LOQ | 49° C. |
| HM125 | T347W | F38 | F468 | >LOQ | >LOQ | 51° C. |
| HM126 | Y357W | F38 | F468 | >LOQ | >LOQ | 55° C. |
| HM130 | W342D | F38 | F468 | >LOQ | >LOQ | 51° C. |
| HM131 | E343Q | F38 | F468 | >LOQ | >LOQ | 50° C. |
| HM132 | T347H | F38 | F468 | >LOQ | >LOQ | 51° C. |
| HM133 | K348F | F38 | F468 | >LOQ | >LOQ | 49° C. |
| HM134 | S350D | F38 | F468 | >LOQ | >LOQ | 54° C. |
| HM135 | Q352Y | F38 | F468 | >LOQ | >LOQ | 51° C. |
| HM136 | A353E | F38 | F468 | >LOQ | >LOQ | 49° C. |
| HM138 | M358Y | F38 | F468 | >LOQ | >LOQ | 48° C. |
| HM139 | D359Q | F38 | F468 | >LOQ | >LOQ | 50° C. |
| HM140 | T360L | F38 | F468 | >LOQ | >LOQ | 49° C. |
| HM141 | T361E | F38 | F468 | >LOQ | >LOQ | 48° C. |
| HM142 | N363E | F38 | F468 | >LOQ | >LOQ | 50° C. |
| HM143 | W342H | F38 | F468 | >LOQ | >LOQ | 50° C. |
| HM144 | K348D | F38 | F468 | >LOQ | >LOQ | 50° C. |
| HM145 | T361H | F38 | F468 | >LOQ | >LOQ | 49° C. |
| HM146 | — | R39 | F468 | >LOQ | >LOQ | 52° C. |
| HM147 | — | A40 | F468 | >LOQ | >LOQ | 53° C. |
| HM149 | — | F38 | D456 | >LOQ | >LOQ | 54° C. |
| HM150 | S350Q, T360R | R39 | F468 | >LOQ | >LOQ | 50° C. |
| HM152 | D65A | F38 | F468 | >LOQ | >LOQ | 51° C |
| HM153 | E66A | F38 | F468 | >LOQ | >LOQ | 51° C. |
| HM154 | P67A | F38 | F468 | >LOQ | >LOQ | 50° C. |
| HM155 | L68A | F38 | F468 | >LOQ | >LOQ | 51° C. |
| HM156 | Q311A | F38 | F 468 | >LOQ | >LOQ | 50° C. |
| HM157 | V312A | F38 | F468 | >LOQ | >LOQ | 56° C. |
| HM158 | L313A | F38 | F468 | >LOQ | >LOQ | 55° C. |
| HM159 | K314A | F38 | F468 | >LOQ | >LOQ | 49° C. |
| HM160 | N266A | F38 | F468 | >LOQ | >LOQ | 49° C. |
| HM161 | T267A | F38 | F468 | >LOQ | >LOQ | 50° C. |
| HM162 | Q268A | F38 | F468 | >LOQ | >LOQ | 51° C. |
| HM163 | Q269A | F38 | F468 | >LOQ | >LOQ | 51° C. |
| HM164 | P271A | F38 | F468 | >LOQ | >LOQ | 51° C. |
| HM165 | V272A | F38 | F468 | >LOQ | >LOQ | 52° C. |
| HM166 | I102A | F38 | F468 | >LOQ | >LOQ | 49° C. |
| HM167 | D103A | F38 | F468 | >LOQ | >LOQ | 53° C. |
| HM168 | S104A | F38 | F468 | >LOQ | >LOQ | 51° C. |
| HM169 | I105A | F38 | F468 | >LOQ | >LOQ | 51° C. |
| HM170 | T132A | F38 | F468 | >LOQ | >LOQ | 51° C. |
| HM171 | F133A | F38 | F468 | >LOQ | >LOQ | 50° C. |
| HM172 | Y134A | F38 | F468 | >LOQ | >LOQ | 52° C. |
| HM173 | V241A | F38 | F468 | >LOQ | >LOQ | 50° C. |
| HM174 | E242A | F38 | F468 | <LOQ | >LOQ | 55° C. |
| HM175 | I243A | F38 | F468 | >LOQ | >LOQ | 49° C. |
| HM176 | K244A | F38 | F468 | >LOQ | >LOQ | 50° C. |
| HM177 | L179A | F38 | F468 | >LOQ | >LOQ | 54° C. |

TABLE 7-continued

Expression level, specific activity, and aggregation
temperature of PH20 variants according to present invention

| Variants | Change from Sequence ID NO. 3 | | | Expression level (LOQ: 300 units/mL) | Specific activity (LOQ: 15 units/μg) | Aggregation point (° C.) |
|---|---|---|---|---|---|---|
| | Amino Acid substitution | Start from | End with | | | |
| HM178 | S180A | F38 | F468 | >LOQ | >LOQ | 50° C. |
| HM179 | L181A | F38 | F468 | >LOQ | >LOQ | 50° C. |
| HM180 | T182A | F38 | F468 | >LOQ | >LOQ | 50° C. |
| HM181 | T185A | F38 | F468 | >LOQ | >LOQ | 50° C. |
| HM182 | E186A | F38 | F468 | >LOQ | >LOQ | 51° C. |
| HM183 | K187A | F38 | F468 | >LOQ | >LOQ | 50° C. |
| HM184 | K290A | F38 | F468 | >LOQ | >LOQ | 50° C. |
| HM185 | I291A | F38 | F468 | >LOQ | >LOQ | 54° C. |
| HM186 | P292A | F38 | F468 | >LOQ | >LOQ | 52° C. |
| HM190 | L441A | F38 | F468 | >LOQ | >LOQ | 50° C. |
| HM191 | S442A | F38 | F468 | >LOQ | >LOQ | 54° C. |
| HM192 | D451A | F38 | F468 | >LOQ | >LOQ | 54° C. |
| HM193 | T452A | F38 | F468 | >LOQ | >LOQ | 53° C. |
| HM194 | D453A | F38 | F468 | >LOQ | >LOQ | 49° C. |
| HM195 | D461A | F38 | F468 | >LOQ | >LOQ | 49° C. |
| HM196 | G462A | F38 | F468 | >LOQ | >LOQ | 50° C. |
| HM197 | V463A | F38 | F468 | >LOQ | >LOQ | 49° C. |
| HM198 | N82A | F38 | F468 | >LOQ | >LOQ | 49° C. |
| HM199 | N166A | F38 | F468 | >LOQ | >LOQ | 50° C. |
| HM203 | S104N | F38 | F468 | >LOQ | >LOQ | 48° C. |
| HM204 | I105Q | F38 | F468 | >LOQ | >LOQ | 51° C. |
| HM205 | Q268D | F38 | F468 | >LOQ | >LOQ | 55° C. |
| HM208 | Q268I | F38 | F468 | <LOQ | >LOQ | 52° C. |
| HM210 | I291G | F38 | F468 | <LOQ | >LOQ | 55° C. |
| HM211 | P292D | F38 | F468 | <LOQ | >LOQ | 53° C. |
| HM212 | T452D | F38 | F468 | >LOQ | >LOQ | 50° C. |
| HM213 | T452H | F38 | F468 | >LOQ | >LOQ | 50° C. |
| HM214 | T452K | F38 | F468 | >LOQ | >LOQ | 52° C. |
| HM216 | T452G | F38 | F468 | >LOQ | >LOQ | 54° C. |
| HM217 | T452P | F38 | F468 | >LOQ | >LOQ | 52° C. |
| HM218 | T452M | F38 | F468 | >LOQ | >LOQ | 52° C. |
| HM219 | T452F | F38 | F468 | >LOQ | >LOQ | 53° C. |
| HM220 | D461R | F38 | F468 | >LOQ | >LOQ | 48° C. |
| HM231 | V463Y | F38 | F468 | >LOQ | >LOQ | 51° C. |
| HM232 | S180T | F38 | F468 | >LOQ | >LOQ | 51° C. |
| HM233 | D451S | F38 | F468 | >LOQ | >LOQ | 51° C. |
| HM234 | L313P | F38 | F468 | >LOQ | >LOQ | 49° C. |
| HM235 | L313M | F38 | F468 | >LOQ | >LOQ | 52° C. |
| HM243 | L179S | F38 | F468 | >LOQ | >LOQ | 52° C. |
| HM245 | L179I | F38 | F468 | >LOQ | >LOQ | 48° C. |
| HM246 | L179F | F38 | F468 | >LOQ | >LOQ | 55° C. |
| HM254 | N344F, K348Q, K355Q | F38 | F468 | >LOQ | >LOQ | 53° C. |
| HM261 | T132S, L181A, E186D, Q268N, I291L, V312A, T452D | F38 | F468 | >LOQ | >LOQ | 56° C. |
| HM262 | — | N37 | F468 | >LOQ | >LOQ | 50° C. |
| HM263 | — | L36 | F468 | >LOQ | >LOQ | 49° C. |
| HM266 | R39K, I105A, T132S, L181M, E186D, Q268A, I291L, V312A, T452D | F38 | F468 | >LOQ | >LOQ | 57° C. |
| HM268 | T132A, L181A, E186A, Q268A, I291L, V312A, T452D | F38 | F468 | >LOQ | >LOQ | 53° C. |
| HM271 | N344I, K348M | F38 | F468 | >LOQ | >LOQ | 51° C. |
| HM275 | S341D, W342L, E343S, N344I, T345S, R346S, K348M, K355D, D359E, T361I | F38 | F468 | >LOQ | >LOQ | 48° C. |
| HM276 | S341D, W342L, E343S, N344I, T345S, K348M, K355D, D359E, T361I | F38 | F468 | >LOQ | >LOQ | 48° C. |

TABLE 7-continued

Expression level, specific activity, and aggregation
temperature of PH20 variants according to present invention

| Variants | Change from Sequence ID NO. 3 | | | Expression level (LOQ: 300 units/mL) | Specific activity (LOQ: 15 units/μg) | Aggregation point (° C.) |
| | Amino Acid substitution | Start from | End with | | | |
| --- | --- | --- | --- | --- | --- | --- |
| HM279 | T132S, L181A, E186D, Q268N, I291L, V312A, K348M, T452D | F38 | F468 | >LOQ | >LOQ | 56° C. |
| HM280 | T132S, L181A, E186D, Q268N, I291L, V312A, N344I, K348M, T452D | F38 | F468 | <LOQ | >LOQ | 59° C. |
| HM287 | T132A, L181A, E186A, Q268A, I291L, V312A, S341D, W342L, E343S, N344I, T345S, R346S, K348M, K355D, D359E, T361I, T452D | F38 | F468 | <LOQ | >LOQ | 48° C. |
| HM288 | T132A, L181A, E186A, Q268A, I291L, V312A, S341D, W342L, E343S, N344I, T345S, K348M, K355D, D359E, T361I, T452D | F38 | F468 | <LOQ | >LOQ | 48° C. |

As can be seen from Table 7 above, among the variants having the amino acid sequence of SEQ ID NO: 3, a total of 133 types of variants having one amino acid residue substitution, namely, HM63, HM64, HM65, HM66, HM67, HM69, HM70, HM71, HM72, HM73, HM74, HM75, HM76, HM77, HM78, HM79, HM82, HM83, HM84, HM85, HM86, HM88, HM89, HM90, HM91, HM92, HM93, HM94, HM95, HM97, HM98, HM99, HM100, HM101, HM102, HM103, HM104, HM105, HM106, HM107, HM110, HM111, HM112, HM114, HM115, HM116, HM117, HM118, HM121, HM125, HM126, HM130, HM131, HM132, HM133, HM134, HM135, HM136, HM138, HM139, HM140, HM141, HM142, HM143, HM144, HM145, HM152, HM153, HM154, HM155, HM156, HM157, HM158, HM159, HM160, HM161, HM162, HM163, HM164, HM165, HM166, HM167, HM168, HM169, HM170, HM171, HM172, HM173, HM174, HM175, HM176, HM177, HM178, HM179, HM180, HM181, HM182, HM183, HM184, HM185, HM186, HM190, HM191, HM192, HM193, HM194, HM195, HM196, HM197, HM198, HM199, HM203, HM204, HM205, HM208, HM210, HM211, HM212, HM213, HM214, HM216, HM217, HM218, HM219, HM220, HM231, HM232, HM233, HM234, HM235, HM243, HM245 and HM246, were variants that still maintain the activity in the purified fraction obtained after purification and have an aggregation temperature of 48 to 58° C. and thus exhibit excellent thermal stability. Theramong, a total of 65 types of variants, namely HM63, HM64, HM65, HM66, HM67, HM69, HM70, HM71, HM72, HM73, HM74, HM75, HM76, HM77, HM78, HM79, HM82, HM83, HM84, HM85, HM86, HM88, HM89, HM90, HM91, HM92, HM93, HM94, HM95, HM98, HM99, HM100, HM101, HM102, HM103, HM104, HM105, HM106, HM107, HM110, HM111, HM112, HM114, HM115, HM116, HM117, HM118, HM121, HM125, HM126, HM130, HM131, HM132, HM133, HM134, HM135, HM136, HM138, HM139, HM140, HM141, HM142, HM143, HM144 and HM145, are variants that are mutated at one of substitution sites in the sequence of SEQ ID NO: 3 from PH20, and have an aggregation temperature of 48° C. to 58° C. There among, a total of 68 types of variants, namely HM97, HM152, HM153, HM154, HM155, HM156, HM157, HM158, HM159, HM160, HM161, HM162, HM163, HM164, HM165, HM166, HM167, HM168, HM169, HM170, HM171, HM172, HM173, HM174, HM175, HM176, HM177, HM178, HM179, HM180, HM181, HM182, HM183, HM184, HM185, HM186, HM190, HM191, HM192, HM193, HM194, HM195, HM196, HM197, HM198, HM199, HM203, HM204, HM205, HM208, HM210, HM211, HM212, HM213, HM214, HM216, HM217, HM218, HM219, HM220, HM231, HM232, HM233, HM234, HM235, HM243, HM245 and HM246, are variants that are mutated at one position of sites other than the substitution sites in SEQ ID NO: 3 from PH20, and have an aggregation temperature of 48° C. to 56° C.

As a result, it can be seen that the variant having substitution at one position from SEQ ID NO: 3 has a higher aggregation temperature than that of wild-type PH20 (L36-Y482) of SEQ ID NO: 1, regardless of the substitution position. However, among them, HM174, HM208, HM210 and HM211 were found to have lower activity in the culture solution than 300 unit/mL, which is LOQ, but have higher activity after purification than 15 unit/μg, which is LOQ. In this case, it is considered that the characteristics of the variant itself cannot be accurately analyzed when the activity of the variant is measured only in the culture solution.

In addition, as shown in Table 7 above, among the variants having the amino acid sequence of SEQ ID NO: 3, HM146, HM147, HM149, HM262 and HM263 retain the same mutations as the variant having the amino acid sequence of SEQ ID NO: 3, that is, substitution of amino acid residues, but further include cleavage at the N-terminus and the C-terminus, which means that the expression and activity of proteins in the variants having the amino acid sequence of SEQ ID NO: 3 are not affected by further cleavage at the N-terminus and the C-terminus. These variants have an aggregation temperature of 49° C. to 53° C., which is not very different from that of the variant of SEQ ID NO: 3, which means that the physical properties of the variants were also unaffected by further cleavage at the N-terminus and the C-terminus.

In addition, in the variants having the amino acid sequence of SEQ ID NO: 3, a total of 13 types of variants, namely HM96, HM150, HM254, HM261, HM266, HM268, HM271, HM275, HM276, HM279, HM280, HM287 and HM288, which are variants including one or more amino acid substitutions and cleavages among those listed in Table 7 above, successfully expressed proteins, further retained enzyme activity, and had an aggregation temperature of 48° C. to 59° C. This means that even in the case of such multiple substitutions, the activity and physical properties of proteins were maintained. However, multiple substitutions exhibited unpredictable enzymatic activity and aggregation temperature which are unpredictable only with the combination of characteristics that are obtained in each single substitution constituting the same.

Example 3. Analysis of Activity of Variants Substituted with Sequences of Hyal2, Hyal3, and Hyal4

The amino acid sequences of Hyal2 (TT-STETCQYLKDYLTRL) (SEQ ID NO: 317), Hyal3 (SS-SEEECWHLHDYLVDT) (SEQ ID NO: 318), and Hyal4 (TASKANCTKVKQFVSSD) (SEQ ID NO: 319), which are the corresponding parts of hyaluronidases present in humans, other than Hyal1, in place of M345 to I361 sites in the amino acid sequence of the wild-type PH20 of SEQ ID NO: 1, were introduced into the M345 to I361 sites to investigate how the stability of proteins changes.

The variants constructed by substituting the M345 to I361 sites of mature wild-type PH20 (L36-S490) with corresponding sequences of Hyal2, Hyal3, and Hyal4, are referred to as "Hyal2-variant", "Hyal3-variant" and "Hyal4-variant", respectively.

The Hyal2-variant, Hyal3-variant and Hyal4-variant were constructed, and then the thermal stability of these variants was analyzed (see FIG. 2). As a result, the aggregation temperature of the Hyal3-variant measured by DLS was 48° C., which was 1.5° C. higher than 46.5° C., which is the aggregation temperature of the wild-type PH20, which means that the thermal stability was increased.

In addition, in order to confirm whether or not these variants were expressed in EXPICHO™ cell culture, the variants were purified by the same method using a HisTrap column, and the expression levels of proteins were compared by SDS-PAGE analysis. The result showed that the expression level of the Hyal3-variant was the highest, followed by the Hyal2-variant and Hyal4-variant in descending order.

Example 4. Analysis of Thermal Stability of Variants According to Present Invention SDS-PAGE analysis was performed to confirm the thermal stability of the variants according to the present invention. The purified wild-type PH20 of SEQ ID NO: 1 (L36-Y482) and the purified protein of SEQ ID NO: 3 (F38-F468) of the PH20 variants according to the present invention were stored at 42° C. for 7 days, followed by 10% SDS-PAGE analysis under reducing and non-reducing conditions (FIG. 4).

As a result, wild-type PH20 (L36-Y482) was observed to aggregate (Lane G in FIG. 4), whereas variant PH20 (F38-F468) of SEQ ID NO: 3 did not aggregate (Lane H in FIG. 4). This difference in aggregation was found to be due to the difference in aggregation temperature between the two proteins. Accordingly, the variant according to the present invention was considered to exhibit higher thermal stability and thus is expected to be widely industrially applicable due to the high aggregation temperature thereof compared to the wild-type PH20.

Example 5. Enzyme Kinetics Analysis of Variants According to Present Invention In order to analyze the enzyme kinetics of the variants according to the present invention, the enzyme activity was measured by the Morgan-Elson method (Takahashi, T. et al (2003) Anal. Biochem. 322:257-263). The Morgan-Elson method is a colorimetric method that assays red substances (at 545 nm) produced by the reaction of the reducing end of N-acetyl-D-glucosamine (GlcNAc) produced upon hydrolysis of hyaluronic acid by hyaluronidase with para-dimethylaminobenzaldehyde (DMAB), which is an Ehrlich's Reagent. N-acetyl-D-glucosamine (GlcNAc, Sigma) diluted to 0.25, 0.50, 0.75, 1.00 or 1.25 mM in dilution buffer solution (0.1 M NaPi, 0.1 M NaCl, 1.5 mM saccharic acid 1,4-lactone, pH 5.35) was reduced by treatment with tetraborate in each test tube, and then DMAB was added to induce colorimetric reaction. After the reaction, absorbance was measured at 545 nm to create a standard reaction curve for GlcNAc. Hyaluronic acid as a substrate was diluted to 0.54, 0.65, 0.87, 1.23 or 2.17 μM in a dilution buffer solution in each test tube, and hyaluronidase was added thereto, followed by reaction at 37° C. for 5 minutes and heating at 100° C. for 5 minutes to terminate the enzyme reaction. The resultant sample after enzyme reaction was reduced by treatment with tetraborate, and DMAB was added to induce colorimetric reaction. After the reaction, absorbance was measured at 545 nm, and enzyme activity was measured using the standard reaction curve of GlcNAc above. The enzyme kinetics of the wild-type PH20 of SEQ ID NO: 1 and the PH20 variant according to the present invention were analyzed using this method. As a result, the linearity of the Lineweaver-Burk curve was detected, which means that the PH20 variant according to the present invention follows the Michaelis-Menten enzyme kinetics equation.

Table 8 shows $V_{max}$ (maximum enzyme reaction rate), $K_M$ (50% substrate concentration), $k_{cat}$ (substrate conversion rate), and $k_{cat}/K_M$ (enzyme catalyst efficiency) obtained as the result of analysis of enzyme kinetics regarding wild-type PH20 (L36-Y482) of SEQ ID NO: 1, variant PH20 (F38-F468) of SEQ ID NO: 3, HM261, and HM268. It can be seen that, as the value of $K_M$ decreases, the substrate-binding capacity of the enzyme increases, and as the value of $k_{cat}$ increases, the substrate conversion rate of the enzyme increases, so $k_{cat}/K_M$ (enzyme catalyst efficiency) of each PH20 variant is higher than that of the wild-type PH20. In addition, the $k_{cat}$ of each of SEQ ID NO: 3, HM261 and HM268 is greater than that of the wild-type PH20 of SEQ ID NO: 1, and thus the substrate conversion rate of the enzyme is larger than that of the wild-type PH20 of SEQ ID NO: 1, so the industrial availability of each PH20 variant is greater than that of the wild-type PH20.

TABLE 8

Results of enzyme kinetics analysis of PH20
variants according to present invention

| | $V_{max}$ ($\mu$M/sec) | $K_M$ ($\mu$M) | $k_{cat}$ (1/sec) | $k_{cat}/K_M$ |
|---|---|---|---|---|
| PH20 SEQ ID NO: 1 (L36-Y482) | 4.5 ± 0.5 | 2.0 ± 0.3 | 30.6 ± 3.0 | 15.1 ± 1.1 |
| SEQ ID NO: 3 (F38-F468) | 3.7 ± 0.3 | 1.3 ± 0.0 | 47.6 ± 3.7 | 36.8 ± 2.0 |
| HM261 | 5.2 ± 0.5 | 1.4 ± 0.2 | 33.9 ± 3.0 | 23.7 ± 2.2 |
| HM268 | 2.9 ± 0.5 | 0.9 ± 0.2 | 37.1 ± 6.4 | 40.0 ± 3.4 |

SEQUENCE LISTING (319 sequences)

SEQ ID NO: 1 - protein, 509 aa, Artificial Sequence
  Synthetic Construct
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 435 aa, Artificial Sequence
  Synthetic Construct
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 3 - protein, 509 aa, Artificial Sequence
  Synthetic Construct
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 4 - protein, 26 aa, Artificial Sequence
  Synthetic Construct
MATGSRTSLLLAFGLLCLPWLQEGSA

SEQ ID NO: 5 - protein, 18 aa, Artificial Sequence
  Synthetic Construct
MKWVTFISLLFLFSSAYS

SEQ ID NO: 6 - protein, 21 aa, Artificial Sequence
  Synthetic Construct
MAAHLLPICALFLTLLDMAQG

SEQ ID NO: 7 - DNA, 93 bp, Artificial Sequence
  Synthetic Construct
atatggggaaccctcagtataactacaagcactgagacctgccaatatctgaaggattacctgaccagactgctgaatccttacataatcaac

SEQ ID NO: 8 - DNA, 93 bp, Artificial Sequence
  Synthetic Construct
atatggggaaccctcagtatatccagcagtgaggaagaatgctggcatttgcacgattacctggtagacacactgaatccttacataatcaac

SEQ ID NO: 9 - DNA, 93 bp, Artificial Sequence
  Synthetic Construct
atatggggaaccctcagtataaccgcatctaaggcaaactgcacaaaagtaaaacaattcgtctccagtgatctgaatccttacataatcaac

SEQ ID NO: 10 - DNA, 33 bp, Artificial Sequence
  Synthetic Construct
gaatatctcgaggccaccatgaagtgggttaca

SEQ ID NO: 11 - DNA, 55 bp, Artificial Sequence
  Synthetic Construct
ctaattgcggccgctcattagtggtgatggtgatgatggaagaaaccaattctgc

SEQ ID NO: 12 - DNA, 44 bp, Artificial Sequence
  Synthetic Construct
aattaggcggccgcctattaaaaggcgtcgatgcacacgccatc

SEQ ID NO: 13 - DNA, 64 bp, Artificial Sequence
  Synthetic Construct
ctctaattgcggccgctcattagtggtgatggtgatgatgaaaggcgtcgatgcacacgccatc

SEQ ID NO: 14 - DNA, 44 bp, Artificial Sequence
  Synthetic Construct
aattagagctcgaggccaccatgaaatgggtgacctttatctcc

SEQ ID NO: 15 - DNA, 28 bp, Artificial Sequence
  Synthetic Construct
cagattctcgaggccaccatgaaatggg

SEQ ID NO: 16 - DNA, 51 bp, Artificial Sequence
  Synthetic Construct
atctggggctcctgggagaacaccaggcagaaggagagctgccaggccatc

SEQ ID NO: 17 - DNA, 54 bp, Artificial Sequence
  Synthetic Construct
atctggggctcctgggagaacaccaggacccaggagagctgccaggccatcaag

SEQ ID NO: 18 - DNA, 44 bp, Artificial Sequence
  Synthetic Construct
agaacaccaggaccaaggagcaatgccaggccatcaaggagtac

SEQ ID NO: 19 - DNA, 44 bp, Artificial Sequence
  Synthetic Construct
aggagagctgccaggccatccaggagtacatggacacaaccctg

SEQ ID NO: 20 - DNA, 51 bp, Artificial Sequence
  Synthetic Construct
agctgccaggccatcaaggagtacgtggacacaaccctgaacccttatatc

SEQ ID NO: 21 - DNA, 42 bp, Artificial Sequence
  Synthetic Construct
aggagtacatggacacaaccgcgaacccttatatcatcaatg

SEQ ID NO: 22 - DNA, 44 bp, Artificial Sequence
  Synthetic Construct
atcgtgatctggggctcctgggtgaacaccaggaccaaggagag

SEQ ID NO: 23 - DNA, 41 bp, Artificial Sequence
  Synthetic Construct
atctggggctcctgggagttcaccaggaccaaggagagctg

SEQ ID NO: 24 - DNA, 51 bp, Artificial Sequence
  Synthetic Construct
agctgccaggccatcaaggagtacatgaaaacaaccctgaacccttatatc

SEQ ID NO: 25 - DNA, 42 bp, Artificial Sequence
  Synthetic Construct
atcaaggagtacatggactacaccctgaacccttatatcatc

SEQ ID NO: 26 - DNA, 42 bp, Artificial Sequence
  Synthetic Construct
atcaaggagtacatggacacaatgctgaacccttatatcatc

SEQ ID NO: 27 - DNA, 43 bp, Artificial Sequence
  Synthetic Construct
accaggaccaaggagagctgcgaggccatcaaggagtacatgg

SEQ ID NO: 28 - DNA, 43 bp, Artificial Sequence
  Synthetic Construct
agtacatggacacaaccctgatgccttatatcatcaatgtgac

SEQ ID NO: 29 - DNA, 46 bp, Artificial Sequence
  Synthetic Construct
tagaagattgtcacgccctggccgttggcattgatccgaggagagc

SEQ ID NO: 30 - DNA, 45 bp, Artificial Sequence
  Synthetic Construct
tgcaccagctcgatggaccgtttcttatacacgtccttaggcttc

SEQ ID NO: 31 - DNA, 45 bp, Artificial Sequence
  Synthetic Construct
accaaggagagctgccaggccgaaaaggagtacatggacacaacc

SEQ ID NO: 32 - DNA, 45 bp, Artificial Sequence
  Synthetic Construct
accaaggagagctgccaggcccaaaaggagtacatggacacaacc

SEQ ID NO: 33 - DNA, 45 bp, Artificial Sequence
  Synthetic Construct
accaaggagagctgccaggcctctaaggagtacatggacacaacc

SEQ ID NO: 34 - DNA, 45 bp, Artificial Sequence
  Synthetic Construct
accaaggagagctgccaggccgtcaaggagtacatggacacaacc

SEQ ID NO: 35 - DNA, 45 bp, Artificial Sequence
  Synthetic Construct
accaaggagagctgccaggccgcgaaggagtacatggacacaacc

SEQ ID NO: 36 - DNA, 45 bp, Artificial Sequence
  Synthetic Construct
accaaggagagctgccaggccaacaaggagtacatggacacaacc

SEQ ID NO: 37 - DNA, 45 bp, Artificial Sequence
  Synthetic Construct
accaaggagagctgccaggccaccaaggagtacatggacacaacc

SEQ ID NO: 38 - DNA, 48 bp, Artificial Sequence
  Synthetic Construct
aaggagagctgccaggccatcaagatgtacatggacacaaccctgaac

SEQ ID NO: 39 - DNA, 48 bp, Artificial Sequence
  Synthetic Construct
aaggagagctgccaggccatcaagttctacatggacacaaccctgaac

SEQ ID NO: 40 - DNA, 48 bp, Artificial Sequence
  Synthetic Construct
aaggagagctgccaggccatcaagatatacatggacacaaccctgaac

SEQ ID NO: 41 - DNA, 48 bp, Artificial Sequence
  Synthetic Construct
aaggagagctgccaggccatcaagttgtacatggacacaaccctgaac

SEQ ID NO: 42 - DNA, 48 bp, Artificial Sequence
  Synthetic Construct
aaggagagctgccaggccatcaagcagtacatggacacaaccctgaac

SEQ ID NO: 43 - DNA, 48 bp, Artificial Sequence
  Synthetic Construct
aaggagagctgccaggccatcaaggtatacatggacacaaccctgaac

SEQ ID NO: 44 - DNA, 96 bp, Artificial Sequence
  Synthetic Construct
atcgtgatctggggctcctgggtgaacaccaggaccaaggagagctgccaggccatcaaggagtacatggacacaatgctgaacccttatatcatc

SEQ ID NO: 45 - DNA, 46 bp, Artificial Sequence
  Synthetic Construct
agctagcggcatcgtgatctggcaatcctgggagaacaccaggacc

SEQ ID NO: 46 - DNA, 45 bp, Artificial Sequence
  Synthetic Construct
agcggcatcgtgatctggggccactgggagaacaccaggaccaag

SEQ ID NO: 47 - DNA, 48 bp, Artificial Sequence
  Synthetic Construct
agcggcatcgtgatctggggctccattgagaacaccaggaccaaggag

SEQ ID NO: 48 - DNA, 44 bp, Artificial Sequence
  Synthetic Construct
atcgtgatctggggctcctggtataacaccaggaccaaggagag

SEQ ID NO: 49 - DNA, 49 bp, Artificial Sequence
  Synthetic Construct
atcgtgatctggggctcctgggagaacgaaaggaccaaggagagctgcc

SEQ ID NO: 50 - DNA, 47 bp, Artificial Sequence
  Synthetic Construct
atctggggctcctgggagaacaccttcaccaaggagagctgccaggc

SEQ ID NO: 51 - DNA, 51 bp, Artificial Sequence
  Synthetic Construct
atctggggctcctgggagaacaccagggaaaaggagagctgccaggccatc

SEQ ID NO: 52 - DNA, 55 bp, Artificial Sequence
  Synthetic Construct
atctggggctcctgggagaacaccaggaccaagttgagctgccaggccatcaagg

SEQ ID NO: 53 - DNA, 41 bp, Artificial Sequence
  Synthetic Construct
agaacaccaggaccaaggagatctgccaggccatcaaggag

SEQ ID NO: 54 - DNA, 45 bp, Artificial Sequence
  Synthetic Construct
accaggaccaaggagagctgcggggccatcaaggagtacatggac

SEQ ID NO: 55 - DNA, 44 bp, Artificial Sequence
  Synthetic Construct
accaaggagagctgccaggccagaaaggagtacatggacacaac

SEQ ID NO: 56 - DNA, 51 bp, Artificial Sequence
  Synthetic Construct
agctgccaggccatcaaggagtaccgggacacaaccctgaacccttatatc

SEQ ID NO: 57 - DNA, 44 bp, Artificial Sequence
  Synthetic Construct
aggccatcaaggagtacatggtcacaaccctgaacccttatatc

SEQ ID NO: 58 - DNA, 47 bp, Artificial Sequence
  Synthetic Construct
aggccatcaaggagtacatggacagaaccctgaacccttatatcatc

SEQ ID NO: 59 - DNA, 45 bp, Artificial Sequence
  Synthetic Construct
atctggggctcctgggagaacaagaggaccaaggagagctgccag

SEQ ID NO: 60 - DNA, 47 bp, Artificial Sequence
  Synthetic Construct
atctggggctcctgggagaacaccctgaccaaggagagctgccaggc

SEQ ID NO: 61 - DNA, 51 bp, Artificial Sequence
  Synthetic Construct
atctggggctcctgggagaacaccagggtcaaggagagctgccaggccatc

SEQ ID NO: 62 - DNA, 57 bp, Artificial Sequence
  Synthetic Construct
atctggggctcctgggagaacaccaggaccaagtggagctgccaggccatcaaggag

SEQ ID NO: 63 - DNA, 44 bp, Artificial Sequence
  Synthetic Construct
accaaggagagctgccaggcctggaaggagtacatggacacaac

SEQ ID NO: 64 - DNA, 44 bp, Artificial Sequence
  Synthetic Construct
aggccatcaaggagtacatgtacacaaccctgaacccttatatc

SEQ ID NO: 65 - DNA, 51 bp, Artificial Sequence
  Synthetic Construct
atctggggctcctgggagaacaccaggtggaaggagagctgccaggccatc

SEQ ID NO: 66 - DNA, 44 bp, Artificial Sequence
  Synthetic Construct
agctgccaggccatcaaggagtggatggacacaaccctgaaccc

SEQ ID NO: 67 - DNA, 48 bp, Artificial Sequence
  Synthetic Construct
agcggcatcgtgatctggggctccgacgagaacaccaggaccaaggag

SEQ ID NO: 68 - DNA, 45 bp, Artificial Sequence
  Synthetic Construct
atcgtgatctggggctcctggcagaacaccaggaccaaggagagc

SEQ ID NO: 69 - DNA, 51 bp, Artificial Sequence
  Synthetic Construct
atctggggctcctgggagaacaccaggcacaaggagagctgccaggccatc

SEQ ID NO: 70 - DNA, 54 bp, Artificial Sequence
  Synthetic Construct
atctggggctcctgggagaacaccaggaccttcgagagctgccaggccatcaag

SEQ ID NO: 71 - DNA, 44 bp, Artificial Sequence
  Synthetic Construct
agaacaccaggaccaaggaggactgccaggccatcaaggagtac

SEQ ID NO: 72 - DNA, 47 bp, Artificial Sequence
  Synthetic Construct
accaggaccaaggagagctgctacgccatcaaggagtacatggacac

SEQ ID NO: 73 - DNA, 44 bp, Artificial Sequence
  Synthetic Construct
aggaccaaggagagctgccaggaaatcaaggagtacatggacac

SEQ ID NO: 74 - DNA, 51 bp, Artificial Sequence
  Synthetic Construct
agctgccaggccatcaaggagtactacgacacaaccctgaacccttatatc

SEQ ID NO: 75 - DNA, 44 bp, Artificial Sequence
  Synthetic Construct
aggccatcaaggagtacatgcagacaaccctgaacccttatatc

SEQ ID NO: 76 - DNA, 47 bp, Artificial Sequence
  Synthetic Construct
aggccatcaaggagtacatggacctaaccctgaacccttatatcatc

SEQ ID NO: 77 - DNA, 46 bp, Artificial Sequence
  Synthetic Construct
atcaaggagtacatggacacagagctgaacccttatatcatcaatg

SEQ ID NO: 78 - DNA, 43 bp, Artificial Sequence
  Synthetic Construct
agtacatggacacaaccctggagccttatatcatcaatgtgac

SEQ ID NO: 79 - DNA, 48 bp, Artificial Sequence
  Synthetic Construct
agcggcatcgtgatctggggctcccatgagaacaccaggaccaaggag

SEQ ID NO: 80 - DNA, 54 bp, Artificial Sequence
  Synthetic Construct
atctggggctcctgggagaacaccaggaccgacgagagctgccaggccatcaag

SEQ ID NO: 81 - DNA, 46 bp, Artificial Sequence
  Synthetic Construct
atcaaggagtacatggacacacacctgaacccttatatcatcaatg

SEQ ID NO: 82 - DNA, 44 bp, Artificial Sequence
  Synthetic Construct
tttggaatcacaggaggagcccgagagtatgcggagctaaacag

SEQ ID NO: 83 - DNA, 41 bp, Artificial Sequence
  Synthetic Construct
tttggaatcacaggaggagcagagtatgcggagctaaacag

SEQ ID NO: 84 - DNA, 62 bp, Artificial Sequence
  Synthetic Construct
ctctaattgcggccgcctattagtggtgatggtgatgatggtccacggcatctgtgtccttc

SEQ ID NO: 85 - DNA, 74 bp, Artificial Sequence
  Synthetic Construct
agaacaccaggaccaaggagcagtgccaggccatcaaggagtacatggaccgaaccctgaacccttatatcatc

SEQ ID NO: 86 - DNA, 55 bp, Artificial Sequence
  Synthetic Construct
taaaagagaacaggctcatatccaggggctcggcaaacttgcccaggcagaactc

SEQ ID NO: 87 - DNA, 53 bp, Artificial Sequence
  Synthetic Construct
taaaagagaacaggctcatatccaggggcgcgtcaaacttgcccaggcagaac

SEQ ID NO: 88 - DNA, 48 bp, Artificial Sequence
  Synthetic Construct
taaaagagaacaggctcatatccagggcctcgtcaaacttgcccaggc

SEQ ID NO: 89 - DNA, 46 bp, Artificial Sequence
  Synthetic Construct
taaaagagaacaggctcatatccgcgggctcgtcaaacttgcccag

SEQ ID NO: 90 - DNA, 42 bp, Artificial Sequence
  Synthetic Construct
accaggatcgtgtttacagacgcggtgctgaagttcctgtcc

SEQ ID NO: 91 - DNA, 42 bp, Artificial Sequence
  Synthetic Construct
aggatcgtgtttacagaccaggcgctgaagttcctgtcccag

SEQ ID NO: 92 - DNA, 42 bp, Artificial Sequence
  Synthetic Construct
atcgtgtttacagaccaggtggcgaagttcctgtcccaggat

SEQ ID NO: 93 - DNA, 45 bp, Artificial Sequence
  Synthetic Construct
atcgtgtttacagaccaggtgctggcgttcctgtcccaggatgag

SEQ ID NO: 94 - DNA, 47 bp, Artificial Sequence
  Synthetic Construct
gccctgtaccctagcatctatctggccacccagcagagcccagtggc

SEQ ID NO: 95 - DNA, 50 bp, Artificial Sequence
  Synthetic Construct
ctgtaccctagcatctatctgaacgcccagcagagcccagtggccgctac

SEQ ID NO: 96 - DNA, 51 bp, Artificial Sequence
  Synthetic Construct
taccctagcatctatctgaacaccgcgcagagcccagtggccgctacactg

SEQ ID NO: 97 - DNA, 55 bp, Artificial Sequence
  Synthetic Construct
taccctagcatctatctgaacacccaggcgagcccagtggccgctacactgtatg

SEQ ID NO: 98 - DNA, 54 bp, Artificial Sequence
  Synthetic Construct
agcatctatctgaacacccagcagagcgcagtggccgctacactgtatgtgagg

SEQ ID NO: 99 - DNA, 48 bp, Artificial Sequence
  Synthetic Construct
tatctgaacacccagcagagcccagcggccgctacactgtatgtgagg

SEQ ID NO: 100 - DNA, 46 bp, Artificial Sequence
  Synthetic Construct
tgtcactccggtgatagaatcggcatatggatagtagcccagtctg

SEQ ID NO: 101 - DNA, 46 bp, Artificial Sequence
  Synthetic Construct
tcactgtcactccggtgatagaagcgatatatggatagtagcccag

SEQ ID NO: 102 - DNA, 51 bp, Artificial Sequence
  Synthetic Construct
tccgttcactgtcactccggtgatagcatcgatatatggatagtagcccag

SEQ ID NO: 103 - DNA, 47 bp, Artificial Sequence
  Synthetic Construct
tccgttcactgtcactccggtggcagaatcgatatatggatagtagc

SEQ ID NO: 104 - DNA, 44 bp, Artificial Sequence
  Synthetic Construct
ttgtccactggcatgtagaaggcgatgtccttcttagccttatc

SEQ ID NO: 105 - DNA, 52 bp, Artificial Sequence
  Synthetic Construct
tgcccagattgtccactggcatgtaggcggtgatgtccttcttagccttatc

SEQ ID NO: 106 - DNA, 45 bp, Artificial Sequence
  Synthetic Construct
tgcccagattgtccactggcatggcgaaggtgatgtccttcttag

SEQ ID NO: 107 - DNA, 50 bp, Artificial Sequence
  Synthetic Construct
agatcgtcgttcctcttgatctccgcattgaaacaggagccgttgtagcc

SEQ ID NO: 108 - DNA, 53 bp, Artificial Sequence
  Synthetic Construct
gacagatcgtcgttcctcttgatcgccacattgaaacaggagccgttgtagcc

SEQ ID NO: 109 - DNA, 54 bp, Artificial Sequence
  Synthetic Construct
agccaagacagatcgtcgttcctcttggcctccacattgaaacaggagccgttg

SEQ ID NO: 110 - DNA, 51 bp, Artificial Sequence
  Synthetic Construct
agccaagacagatcgtcgttcctcgcgatctccacattgaaacaggagccg

SEQ ID NO: 111 - DNA, 44 bp, Artificial Sequence
  Synthetic Construct
tctgtggcctcggtcaggctcgcctgcacgttctgctgctgcac

SEQ ID NO: 112 - DNA, 44 bp, Artificial Sequence
  Synthetic Construct
ttctctgtggcctcggtcagggccagctgcacgttctgctgctg

SEQ ID NO: 113 - DNA, 46 bp, Artificial Sequence
  Synthetic Construct
tagccttctctgtggcctcggtcgcgctcagctgcacgttctgctg

SEQ ID NO: 114 - DNA, 44 bp, Artificial Sequence
  Synthetic Construct
ttagccttctctgtggcctcggccaggctcagctgcacgttctg

SEQ ID NO: 115 - DNA, 47 bp, Artificial Sequence
  Synthetic Construct
tcgaactcctgcttagccttctctgcggcctcggtcaggctcagctg

SEQ ID NO: 116 - DNA, 44 bp, Artificial Sequence
  Synthetic Construct
tcgaactcctgcttagccttcgctgtggcctcggtcaggctcag

SEQ ID NO: 117 - DNA, 43 bp, Artificial Sequence
  Synthetic Construct
ttctcgaactcctgcttagccgcctctgtggcctcggtcaggc

SEQ ID NO: 118 - DNA, 46 bp, Artificial Sequence
  Synthetic Construct
agagaggctatccgcgtgtctgcgatccccgacgccaagtccccac

SEQ ID NO: 119 - DNA, 44 bp, Artificial Sequence
  Synthetic Construct
aggctatccgcgtgtctaaggcccccgacgccaagtccccactg

SEQ ID NO: 120 - DNA, 47 bp, Artificial Sequence
  Synthetic Construct
aggctatccgcgtgtctaagatcgccgacgccaagtccccactgccc

SEQ ID NO: 121 - DNA, 51 bp, Artificial Sequence
  Synthetic Construct
agttttactgctcttgttattccaccgcgagctgtaaggagaaggctgatg

SEQ ID NO: 122 - DNA, 47 bp, Artificial Sequence
  Synthetic Construct
actgctcttgttattccaccctggcctgtaaggagaaggctgatgtg

SEQ ID NO: 123 - DNA, 45 bp, Artificial Sequence
  Synthetic Construct
aaggagaaggctgatgtgaaggccacagatgccgtggacgtgtgc

SEQ ID NO: 124 - DNA, 48 bp, Artificial Sequence
  Synthetic Construct
aaggagaaggctgatgtgaaggacgcagatgccgtggacgtgtgcatc

SEQ ID NO: 125 - DNA, 43 bp, Artificial Sequence
  Synthetic Construct
aaggctgatgtgaaggacacagctgccgtggacgtgtgcatcg

SEQ ID NO: 126 - DNA, 81 bp, Artificial Sequence
  Synthetic Construct
atattcgcggccgcctattagtggtgatggtgatgatgaaaggcgtcgatgcacacgccagcagcgatgcacacgtccacg

SEQ ID NO: 127 - DNA, 80 bp, Artificial Sequence
  Synthetic Construct
atattcgcggccgcctattagtggtgatggtgatgatgaaaggcgtcgatgcacacggcatcagcgatgcacacgtccac

SEQ ID NO: 128 - DNA, 75 bp, Artificial Sequence
  Synthetic Construct
atattcgcggccgcctattagtggtgatggtgatgatgaaaggcgtcgatgcacgcgccatcagcgatgcacacg

SEQ ID NO: 129 - DNA, 47 bp, Artificial Sequence
  Synthetic Construct
tgtcacgccctggccggtggcagcgatccgaggagagccgataaaag

SEQ ID NO: 130 - DNA, 45 bp, Artificial Sequence
  Synthetic Construct
tgcaccagctcgatggaccgagccttatacacgtccttaggcttc

SEQ ID NO: 131 - DNA, 44 bp, Artificial Sequence
  Synthetic Construct
ttcactgtcactccggtgatattatcgatatatggatagtagcc

SEQ ID NO: 132 - DNA, 47 bp, Artificial Sequence
  Synthetic Construct
tccgttcactgtcactccggtctgagaatcgatatatggatagtagc

SEQ ID NO: 133 - DNA, 46 bp, Artificial Sequence
  Synthetic Construct
accctagcatctatctgaacaccgatcagagcccagtggccgctac

SEQ ID NO: 134 - DNA, 46 bp, Artificial Sequence
  Synthetic Construct
accctagcatctatctgaacaccatccagagcccagtggccgctac

SEQ ID NO: 135 - DNA, 42 bp, Artificial Sequence
  Synthetic Construct
aggctatccgcgtgtctaagggccccgacgccaagtccccac

SEQ ID NO: 136 - DNA, 40 bp, Artificial Sequence
  Synthetic Construct
atccgcgtgtctaagatcgacgacgccaagtccccactgc

SEQ ID NO: 137 - DNA, 40 bp, Artificial Sequence
  Synthetic Construct
agaaggctgatgtgaaggacgacgatgccgtggacgtgtg

SEQ ID NO: 138 - DNA, 40 bp, Artificial Sequence
  Synthetic Construct
agaaggctgatgtgaaggaccacgatgccgtggacgtgtg

SEQ ID NO: 139 - DNA, 40 bp, Artificial Sequence
  Synthetic Construct
agaaggctgatgtgaaggacaaagatgccgtggacgtgtg

SEQ ID NO: 140 - DNA, 40 bp, Artificial Sequence
  Synthetic Construct
agaaggctgatgtgaaggacggagatgccgtggacgtgtg

SEQ ID NO: 141 - DNA, 40 bp, Artificial Sequence
  Synthetic Construct
agaaggctgatgtgaaggacccagatgccgtggacgtgtg

SEQ ID NO: 142 - DNA, 40 bp, Artificial Sequence
  Synthetic Construct
agaaggctgatgtgaaggacatggatgccgtggacgtgtg

SEQ ID NO: 143 - DNA, 40 bp, Artificial Sequence
  Synthetic Construct
agaaggctgatgtgaaggacttcgatgccgtggacgtgtg

SEQ ID NO: 144 - DNA, 82 bp, Artificial Sequence
  Synthetic Construct
ctctaattgcggccgcctattagtggtgatggtgatgatgaaaggcgtcgatgcacacgcccctagcgatgcacacgtccac

SEQ ID NO: 145 - DNA, 76 bp, Artificial Sequence
  Synthetic Construct
ctctaattgcggccgctcattagtggtgatggtgatgatgaaaggcgtcgatgcagtagccatcagcgatgcacac

SEQ ID NO: 146 - DNA, 44 bp, Artificial Sequence
  Synthetic Construct
ttctctgtggcctcggtcagggtcagctgcacgttctgctgctg

SEQ ID NO: 147 - DNA, 41 bp, Artificial Sequence
  Synthetic Construct
aggagaaggctgatgtgaagagcacagatgccgtggacgtg

SEQ ID NO: 148 - DNA, 45 bp, Artificial Sequence
  Synthetic Construct
atcgtgtttacagaccaggtgccgaagttcctgtcccaggatgag

SEQ ID NO: 149 - DNA, 45 bp, Artificial Sequence
  Synthetic Construct
atcgtgtttacagaccaggtgatgaagttcctgtcccaggatgag

SEQ ID NO: 150 - DNA, 44 bp, Artificial Sequence
  Synthetic Construct
tctgtggcctcggtcaggctcgactgcacgttctgctgctgcac

SEQ ID NO: 151 - DNA, 44 bp, Artificial Sequence
  Synthetic Construct
tctgtggcctcggtcaggctaatctgcacgttctgctgctgcac

SEQ ID NO: 152 - DNA, 44 bp, Artificial Sequence
  Synthetic Construct
tctgtggcctcggtcaggctaaactgcacgttctgctgctgcac

SEQ ID NO: 153 - DNA, 84 bp, Artificial Sequence
  Synthetic Construct
atcgtgatctggggctcctgggagttcaccaggacccaggagagctgccaggccatccaggagtacatggacacaaccctgaac

SEQ ID NO: 154 - DNA, 46 bp, Artificial Sequence
  Synthetic Construct
accctagcatctatctgaacaccaaccagagcccagtggccgctac

SEQ ID NO: 155 - DNA, 17 bp, Artificial Sequence
  Synthetic Construct
gcccaggcagaactcgc

SEQ ID NO: 156 - DNA, 62 bp, Artificial Sequence
  Synthetic Construct
tctcgaactcctgcttagccttatctgtggcctcggtcatgctcagctgcacgttctgctgc

SEQ ID NO: 157 - DNA, 46 bp, Artificial Sequence
  Synthetic Construct
accctagcatctatctgaacaccgcgcagagcccagtggccgctac

SEQ ID NO: 158 - DNA, 60 bp, Artificial Sequence
  Synthetic Construct
atcgtgatctggggctcctgggagatcaccaggaccatggagagctgccaggccatcaag

SEQ ID NO: 159 - DNA, 60 bp, Artificial Sequence
  Synthetic Construct
agcggcatcgtgatctggggcgacctgtcgatctcctcgaccatggagagctgccaggcc

SEQ ID NO: 160 - DNA, 57 bp, Artificial Sequence
  Synthetic Construct
agcggcatcgtgatctggggcgacctgtcgatctccaggaccatggagagctgccag

SEQ ID NO: 161 - DNA, 54 bp, Artificial Sequence
  Synthetic Construct
atctggggctcctgggagaacaccaggaccatggagagctgccaggccatcaag

SEQ ID NO: 162 - DNA, 60 bp, Artificial Sequence; identical to SEQ ID NO: 158
  Synthetic Construct

SEQ ID NO: 163 - protein, 455 aa, Artificial Sequence
  Synthetic Construct
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSITTSTETCQYLKDYLTRLLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 164 - protein, 455 aa, Artificial Sequence
  Synthetic Construct
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSISSSEEECWHLHDYLVDTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 165 - protein, 455 aa, Artificial Sequence
  Synthetic Construct
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSITASKANCTKVKQFVSSDLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 166 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTMTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 167 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRQKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 168 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTQESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKEQCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 170 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIQEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 171 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYVDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 172 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTANPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 173 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWVNTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 174 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWEFTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 175 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMKTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 176 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDYTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 177 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTMLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 178 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCEAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 179 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLMPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 180 - protein, 431 aa, Artificial Sequence
  Synthetic Construct
FRAPPVIPNVPFLWAWNAPSEFCLGKFDEPLDMSLFSFIGSPRINANGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 181 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKKRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 182 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAEKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 183 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAQKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 184 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQASKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 185 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAVKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 186 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAAKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 187 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQANKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 188 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQATKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 189 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKMYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 190 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKFYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 191 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKIYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 192 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKLYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 193 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKQYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 194 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKVYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 195 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKKRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWVNTRTKESCQAIKEYMDTMLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 196 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWQSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 197 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGHWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 198 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSIENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 199 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWYNTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 200 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENERTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 201 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTFTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 202 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTREKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 203 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKLSCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 204 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKEICQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 205 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCGAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 206 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQARKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 207 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYRDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 208 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMVTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 209 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDRTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 210 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENKRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 211 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTLTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 212 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRVKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 213 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKWSCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 214 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAWKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 215 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMYTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 216 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRWKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 217 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEWMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 218 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSDENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 219 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWQNTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 220 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRHKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 221 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTFESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 222 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKEDCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 223 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCYAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 224 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQEIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 225 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYYDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 226 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMQTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 227 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDLTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 228 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTELNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 229 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLEPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 230 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSHENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 231 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTDESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 232 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTHLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 233 - protein, 430 aa, Artificial Sequence
  Synthetic Construct
RAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 234 - protein, 429 aa, Artificial Sequence
  Synthetic Construct
APPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 235 - protein, 419 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 236 - protein, 430 aa, Artificial Sequence
  Synthetic Construct
RAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKEQCQAIKEYMDRTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 237 - protein, 431 aa, Artificial Sequence
  Synthetic Construct
FRAPPVIPNVPFLWAWNAPSEFCLGKFAEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 238 - protein, 431 aa, Artificial Sequence
  Synthetic Construct
FRAPPVIPNVPFLWAWNAPSEFCLGKFDAPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 239 - protein, 431 aa, Artificial Sequence
  Synthetic Construct
FRAPPVIPNVPFLWAWNAPSEFCLGKFDEALDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 240 - protein, 431 aa, Artificial Sequence
  Synthetic Construct
FRAPPVIPNVPFLWAWNAPSEFCLGKFDEPADMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 241 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDAVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 242 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQALKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 243 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVAKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 244 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLAFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 245 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLATQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 246 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNAQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 247 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTAQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 248 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQASPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 249 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSAVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 250 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPAAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 251 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYADSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 252 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIASITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 253 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDAITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 254 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSATGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 255 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDIAFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 256 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITAYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 257 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFAMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 258 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNAEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 259 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVAIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 260 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEAKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 261 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIARNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 262 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQASLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 263 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLALTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 264 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSATEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 265 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLAEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 266 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEAAEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 267 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATAKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 268 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEAAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 269 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSAIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 270 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKAPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 271 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIADAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 272 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTASCKEKADVKDTDAVDVCIADGVCIDAF

SEQ ID NO: 273 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLACKEKADVKDTDAVDVCIADGVCIDAF

SEQ ID NO: 274 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKATDAVDVCIADGVCIDAF

SEQ ID NO: 275 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDADAVDVCIADGVCIDAF

SEQ ID NO: 276 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTAAVDVCIADGVCIDAF

SEQ ID NO: 277 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIAAGVCIDAF

SEQ ID NO: 278 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADAVCIDAF

SEQ ID NO: 279 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGACIDAF

SEQ ID NO: 280 - protein, 431 aa, Artificial Sequence
  Synthetic Construct
FRAPPVIPNVPFLWAWNAPSEFCLGKFDEPLDMSLFSFIGSPRIAATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 281 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKARSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 282 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDNITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 283 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSQTGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 284 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTDQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 285 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTIQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 286 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKGPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 287 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIDDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 288 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 289 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDHDAVDVCIADGVCIDAF

SEQ ID NO: 290 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDKDAVDVCIADGVCIDAF

SEQ ID NO: 291 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDGDAVDVCIADGVCIDAF

SEQ ID NO: 292 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDPDAVDVCIADGVCIDAF

SEQ ID NO: 293 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDMDAVDVCIADGVCIDAF

SEQ ID NO: 294 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDFDAVDVCIADGVCIDAF

SEQ ID NO: 295 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIARGVCIDAF

SEQ ID NO: 296 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGYCIDAF

SEQ ID NO: 297 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLTLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 298 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKSTDAVDVCIADGVCIDAF

SEQ ID NO: 299 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVPKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 300 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVMKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 301 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQSSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 302 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQISLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 303 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQFSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 304 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWEFTRTQESCQAIQEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 305 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDISFYMPVDNLGMAVIDWEEWRPTWARNWKPKDVYKNRSIELVQQQNVQLSATEATDKAKQEFEKAGKDFLVETIKLGKLLRPNHLWGYYLFPDCYNHHYKKPGYNGSCFNVEIKRNDDLSWLWNESTALYPSIYLNTNQSPVAATLYVRNRVREAIRVSKLPDAKSPLPVFAYTRIVFTDQALKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 306 - protein, 432 aa, Artificial Sequence
  Synthetic Construct
NFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 307 - protein, 433 aa, Artificial Sequence
  Synthetic Construct
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 308 - protein, 431 aa, Artificial Sequence
  Synthetic Construct
FKAPPVIPNVPFLWAWNAPSEFCLGKFDEPLDMSLFSFIGSPRINATGQGVTIFYVDRLGYYPYIDSATGVTVNGGIPQKISLQDHLDKAKKDISFYMPVDNLGMAVIDWEEWRPTWARNWKPKDVYKNRSIELVQQQNVQLSMTEATDKAKQEFEKAGKDFLVETIKLGKLLRPNHLWGYYLFPDCYNHHYKKPGYNGSCFNVEIKRNDDLSWLWNESTALYPSIYLNTAQSPVAATLYVRNRVREAIRVSKLPDAKSPLPVFAYTRIVFTDQALKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 309 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDIAFYMPVDNLGMAVIDWEEWRPTWARNWKPKDVYKNRSIELVQQQNVQLSATEATAKAKQEFEKAGKDFLVETIKLGKLLRPNHLWGYYLFPDCYNHHYKKPGYNGSCFNVEIKRNDDLSWLWNESTALYPSIYLNTAQSPVAATLYVRNRVREAIRVSKLPDAKSPLPVFAYTRIVFTDQALKFLSQDELVYTFGETVALGASGIVIWGSWENTRTKESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 310 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGSWEITRTMESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 311 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGDLSISSTMESCQAIDEYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 312 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGDLSISRTMESCQAIDEYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 313 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDISFYMPVDNLGMAVIDWEEWRPTWARNWKPKDVYKNRSIELVQQQNVQLSATEATDKAKQEFEKAGKDFLVETIKLGKLLRPNHLWGYYLFPDCYNHHYKKPGYNGSCFNVEIKRNDDLSWLWNESTALYPSIYLNTNQSPVAATLYVRNRVREAIRVSKLPDAKSPLPVFAYTRIVFTDQALKFLSQDELVYTFGETVALGASGIVIWGSWENTRTMESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 314 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDISFYMPVDNLGMAVIDWEEWRPTWARNWKPKDVYKNRSIELVQQQNVQLSATEATDKAKQEFEKAGKDFLVETIKLGKLLRPNHLWGYYLFPDCYNHHYKKPGYNGSCFNVEIKRNDDLSWLWNESTALYPSIYLNTNQSPVAATLYVRNRVREAIRVSKLPDAKSPLPVFAYTRIVFTDQALKFLSQDELVYTFGETVALGASGIVIWGSWEITRTMESCQAIKEYMDTTLNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 315 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDIAFYMPVDNLGMAVIDWEEWRPTWARNWKPKDVYKNRSIELVQQQNVQLSATEATAKAKQEFEKAGKDFLVETIKLGKLLRPNHLWGYYLFPDCYNHHYKKPGYNGSCFNVEIKRNDDLSWLWNESTALYPSIYLNTAQSPVAATLYVRNRVREAIRVSKLPDAKSPLPVFAYTRIVFTDQALKFLSQDELVYTFGETVALGASGIVIWGDLSISSTMESCQAIDEYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 316 - protein, 431 aa, Artificial Sequence
  Synthetic Construct
FRAPPVIPNVPFLWAWNAPSEFCLGKFDEPLDMSLFSFIGSPRINATGQGVTIFYVDRLGYYPYIDSITGVTVNGGIPQKISLQDHLDKAKKDIAFYMPVDNLGMAVIDWEEWRPTWARNWKPKDVYKNRSIELVQQQNVQLSATEATAKAKQEFEKAGKDFLVETIKLGKLLRPNHLWGYYLFPDCYNHHYKKPGYNGSCFNVEIKRNDDLSWLWNESTALYPSIYLNTAQSPVAATLYVRNRVREAIRVSKLPDAKSPLPVFAYTRIVFTDQALKFLSQDELVYTFGETVALGASGIVIWGDLSISRTMESCQAIDEYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDDDAVDVCIADGVCIDAF

SEQ ID NO: 317 - protein, 17 aa, Artificial Sequence
  Synthetic Construct
TTSTETCQYLKDYLTRL

SEQ ID NO: 318 - protein, 17 aa, Artificial Sequence
  Synthetic Construct
SSSEEECWHLHDYLVDT

SEQ ID NO: 319 - protein, 17 aa, Artificial Sequence
  Synthetic Construct
TASKANCTKVKQFVSSD

What is claimed is:

1. A PH20 variant, wherein the amino acid sequence of the PH20 variant is SEQ ID NO: 3 with modifications consisting of:

(a) an amino acid residue substitution of: Y357W, M358V, M358R, L362A, W342I, or E343V relative to SEQ ID NO: 3;

(b) an N-terminus deletion of amino acid residues M1 to T35, M1 to L36, M1 to N37, M1 to F38, M1 to R39, or M1 to A40 of SEQ ID NO: 3; and (c) a C-terminus deletion, wherein the C-terminus of the PH20 variant ends with an amino acid residue selected from any one of amino acid residues I465 to S490 of SEQ ID NO: 3, and wherein the PH20 variant exhibits higher enzymatic activity compared to mature, wild-type human PH20 under the same conditions.

2. The PH20 variant of claim 1, wherein the amino acid residue substitution is Y357W, M358V, or M358R relative to SEQ ID NO: 3.

3. The PH20 variant of claim 1, wherein the amino acid residue substitution is L362A.

4. The PH20 variant of claim 1, wherein the amino acid residue substitution is W342I or E343V relative to SEQ ID NO: 3.

5. The PH20 variant of claim 1, wherein the amino acid sequence of the PH20 variant consists of the amino acid sequence of SEQ ID NO: 217, 171, or 207.

6. The PH20 variant of claim 1, wherein the amino acid sequence of the PH20 variant consists of the amino acid sequence of SEQ ID NO: 172.

7. The PH20 variant of claim 1, wherein the amino acid sequence of the PH20 variant consists of the amino acid sequence of SEQ ID NO: 198 or 173.

8. A pharmaceutical composition comprising the PH20 variant of claim 1, and one or more selected from the group consisting of diluents, excipients, lubricants, wetting agents, sweeteners, aromatics, emulsifiers, suspensions and preservatives.

9. The pharmaceutical composition of claim 8, wherein the pharmaceutical composition is formulated for subcutaneous injection.

10. The pharmaceutical composition of claim 8, wherein the pharmaceutical composition further comprises a protein drug and is formulated for subcutaneous injection.

11. The pharmaceutical composition of claim 8, wherein the pharmaceutical composition further comprises an anticancer drug and is formulated for subcutaneous injection.

12. A PH20 variant comprising the amino acid sequence of SEQ ID NO: 217, 171, or 207.

13. A PH20 variant comprising the amino acid sequence of SEQ ID NO: 172.

14. A PH20 variant comprising the amino acid sequence of SEQ ID NO: 198 or 173.

15. A pharmaceutical composition comprising the PH20 variant of claim 12, and one or more selected from the group consisting of diluents, excipients, lubricants, wetting agents, sweeteners, aromatics, emulsifiers, suspensions and preservatives.

16. The pharmaceutical composition of claim 15, wherein the pharmaceutical composition is formulated for subcutaneous injection.

17. The pharmaceutical composition of claim 15, wherein the pharmaceutical composition further comprises a protein drug for treating a disease and is formulated for subcutaneous injection.

18. The pharmaceutical composition of claim 15, wherein the pharmaceutical composition further comprises an anticancer drug and is formulated for subcutaneous injection.

19. A pharmaceutical composition comprising the PH20 variant of claim 13, and one or more selected from the group consisting of diluents, excipients, lubricants, wetting agents, sweeteners, aromatics, emulsifiers, suspensions and preservatives.

20. The pharmaceutical composition of claim 19, wherein the pharmaceutical composition is formulated for subcutaneous injection.

21. The pharmaceutical composition of claim 19, wherein the pharmaceutical composition further comprises a protein drug for treating a disease and is formulated for subcutaneous injection.

22. The pharmaceutical composition of claim 19, wherein the pharmaceutical composition further comprises an anticancer drug and is formulated for subcutaneous injection.

23. A pharmaceutical composition comprising the PH20 variant of claim 14, and one or more selected from the group consisting of diluents, excipients, lubricants, wetting agents, sweeteners, aromatics, emulsifiers, suspensions and preservatives.

24. The pharmaceutical composition of claim 23, wherein the pharmaceutical composition is formulated for subcutaneous injection.

25. The pharmaceutical composition of claim 23, wherein the pharmaceutical composition further comprises a protein drug for treating a disease and is formulated for subcutaneous injection.

26. The pharmaceutical composition of claim 23, wherein the pharmaceutical composition further comprises an anticancer drug and is formulated for subcutaneous injection.

27. The PH20 variant of claim 1, wherein: (b) the N-terminus deletion is a deletion of amino acid residues M1 to N37 of SEQ ID NO: 3, or (c) the C-terminus of the PH20 variant ends at F468.

28. A PH20 variant, wherein the amino acid sequence of the PH20 variant is SEQ ID NO: 3 with modifications consisting essentially of:

(a) an amino acid residue substitution of: Y357W, M358V, M358R, L362A, W342I, or E343V relative to SEQ ID NO: 3;

(b) an N-terminus deletion of amino acid residues M1 to T35, M1 to L36, M1 to N37, M1 to F38, M1 to R39, or M1 to A40 of SEQ ID NO: 3; and

(c) a C-terminus deletion, wherein the C-terminus of the PH20 variant ends with an amino acid residue selected from any one of amino acid residues I465 to S490 of SEQ ID NO: 3, and wherein the PH20 variant exhibits higher enzymatic activity compared to mature, wild-type human PH20 under the same conditions.

29. A pharmaceutical composition comprising the PH20 variant of claim 28, and one or more selected from the group consisting of diluents, excipients, lubricants, wetting agents, sweeteners, aromatics, emulsifiers, suspensions and preservatives.

30. The pharmaceutical composition of claim 29, wherein the pharmaceutical composition is formulated for subcutaneous injection.

31. The pharmaceutical composition of claim 29, wherein the pharmaceutical composition further comprises a protein drug for treating a disease and is formulated for subcutaneous injection.

32. The pharmaceutical composition of claim 29, wherein the pharmaceutical composition further comprises an anticancer drug and is formulated for subcutaneous injection.

* * * * *